United States Patent 11,913,074 (METHODS FOR ASSESSING RISK OF DEVELOPING A VIRAL DISEASE USING A GENETIC TEST) - sequence listing, part 4

SEQ ID NO: 121 - DNA, 29191 bp, Homo sapiens
  source 1..29191: mol_type = genomic DNA
gctgagtagggaatggagcaatttctgacagaggcttttcctgaaggcgtgggtgttgctgagtggtggtgtcctgtcagcctcttctcttctggtggcagcagagcctggcactggaatagcctgtggctgagcttcaggtttcctgtcactttggctggggtgtgggctgaccaccagatgtgtgctcagggcgcagctcagccagtggtgagcagcttacttgcatgggcttttcccatgctgagttttgaggggtggagggaggaaatgggggtgctgctttgtgggacagcagtgggagccctgccagaggtgaatgtgtgggtactcctgggggactcggtctcggggaggccaggggctcaggagtcagattggttttccatctggcaggagtgctggcaggttgggggagacaggggtgggggtgaagccaaatctttggccttgctttccccctacttgctgagagtgccctggaggaagatggcgggcaggtagggctgcagcccccgctgggctggctgagacccctgggaagggaggtctccaagtgcctgctcctgcagctctgagtgcatatgcgctccccacagctgcccccttctccggggaacccccatcagcttgaggagcctggggggtggggttaggcatttgctctcgccttcctttcccccttgctttgggtggccccaactcttaccccatcctgctgccctcccttcctccttcctgggcacactccctggggaaatcacacccatccacattttggaatgtcagcagacatgctgaccacgtgacccagccatccgccttggtgtccacctggggagatgaaatcttctgttcacacgaacctatctccggaggttcatagcaggactattcacatctgccaaaaactggagatggcccagatgctcttcagtgggtaaatggagaaacagatgcggcccatccatgcgagggatcactgctcctccgaaaaaaggcttgggccacagatatgtacaatgacttggatacatctcagaggcatcatgttggatgaaagaagctaatctcaaaagattatattccattttatttgacttttttttgttttgttttgttttgagggtcttgctgtgtcagccaggctggagtgcagtggagtgatcatggctcactgcagccttaacctcctgggctcaagcagtcctcccaccttggtcttccaaagtgctgggattatagacgtgagccactacacctgtcctggcctttattttattttagttaattaattagagatagggtcttattctgtgacccaggctggagtgcagtgatacagtcatagcccactacagccataatctcccaggctcaagcagtcctcccaccttagcttcctgagtagctggaactacaggcacacgccaccacgcctgcctaatttttgtatttttagtagtgaagaggttttgccatgttggccaggctggtctcgaactcctgacctcaggtgatctgtccacctcggcctcccaaagtgctggaattacagatgtaagctactatacctggcctgttcgacattttttcttttatttatttattttttttgagacggagtctccctttgtcgcccaggttggagtgcagtggcgcgatcttggcccactgcagcctccgcctcctgggttcaagcgattctcctgcttcagcctcccgagtagctgggattacaggcatgccccgccacacccggctaatttttgtatttttagtagagacggggtttcaccatgttggccaggctggtctccaactcctgacctcaggtgatccccccacctcagcctcccaaagtgctaggattgcaggcatgagcctctgcacccggccgacattttctaagttgatgaaactatagctttagagagcaaatcagtggttgtcagggcgtaggcggggaggagaggttgcatgaggaagtttttttgagtgtagatggtgataccaacacgaatctatacacatgttaaaatcatagaattgtatataaaattaattacttttagttatgatggtttaaaaaatagtcacatctacccatattgctgtctcaggaagcccctccgcttggccagaatggagcagccgaagggagttgattggacagtcatcatcctgacctgccagtacaaggacagtgtccaggtctttcagagaggtaggggactccccttcccaccttgcccctaatggagaacctccctccccttcctggctatgtccctccaacaccaggtgccaggccaacctgggttcaaacccagattgcacttctccctagccatgtgacagcatacgtggcatgtcattccttgtgccttagttttctcatctgtaagatgggagtaatatgacttctctcactaagttgggtgaagatctagtggcctcctacatggaaagctaagtcaaggaagatcaaacactgatgatcagtaggcttgcttacgtgctttgggccagggcagagagctggggggcaggtcccagtgtctcttctgaccctagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtgagtgctcaccagggccacctccctggtctgtgtccctgctggaaccaggtcatttctgagatccccagctcctctggctccatcgccttggccaactcagcattggtctcagtttttgtttctgtaaattgggcggactcatctctgccttgccgttcaagtgagggcagaaggcagggccagcttttgcagtgtttttagagagttgtagccaatatctcaaagtgaggctttctggcttctcttgaaacattcaaaggtcttgctagcctgggctgtcatccccatatggcaacgaactgttcgctggacctgagctgcggctgcctgctttgggcaggccatgtgagtcagcatccctgctggtcccgtgtctcccatgcaaccagccacttcacccggtcaccttgtctgcatagcatctttgtgtgcagagtgagggcgagcacagacttggacatgctctgcagagggagatggcaccagcaggggaggggaccactgtagctgccatggcgctgactcccctaagtcacccagccagcccccaactcttgttgcctgtaacctccccttcaaaacagacagcagaggccgggcgcggtggctcatgcctttaatcccagcactttgggaggccgaggtgggtggatcacctgaggtcaggagttggagaccagcctgaccaacgtgatgaaaccccgtctctactaaaaatacaaaaattagctgggcctggttgcacacacctgtaatcccagctactcgggaggctgaggcaggagagtcgcttgaacccaggaggtggaggttgcagtgagctgagatcatgccattgcagtgagctgagatcatgccattgcagtgagctgagatcatgccattgcactccattctgggcaacagagcgagactgcatctcaaaaaaaaaaaaaaaaaaaaatttaagaggtagccaggcgtggcagtgcacacctgtagtcccagctagttaagaggctgaggtgggaggctcgcttgagcccaagagaccaaggctgcagtgagctgggatcataccactgcactccagactgggtgacagagtgagaccctgtctcaaaacaacaacaacaacagcaacaaaccagccagcaagaaggtggcccaggtggagggccctgggatcccttatccaggagggaccagggctgccccttgtctgcctgtggccattggtttgaccttgccttttgtcccttgggtacctgagtggatttgtgttggagtctctctctggattcgagggtgccatcctccagggcgtctgcctgaggcctctgttcacagggctttcccactcctgcaggtggtcacatccgatgtcctgcactcggcctggatcctcattctgcacatggtaaatgaactttggggcaggggccaagcagaaggccagaatcccagttcgtggagttgagcaggacttcaggggtgttctgccactgtgtgtgtgcaagatgaaatctgaaagattctaaatgtccaaaaattgggaaatggctaaatatataccacatattttcccagcagaatattagattgaaaggtccatctagggccgggcgcagtggctcatgcctgtaaatctcagcactttgggaggccaaggcgggaggattgcttgagcccaggagatcgagaccagcctgggcaacatggtgaaacctcatctctataagaaatacaaaaattagccgccatggtggtgcacacctgtagtcccagctactcaggaggctgaggtgggaggatcacttgagcctgggaggttgaggctgcagtgagttatgattacaccactgcactccagcctgtgtgaccctttctcaaaaaataaaattataggctgggcgcagtggctcacatctgtaaagtggctcacacagcgctttgggaggttgaggcgggcagatcacaaggtcaggagtttgagatcagcctggccagcatggtgaaactctgtctttactaaaaatacaaaaaattagccaggcatggtggtgcatgcctgtagtcccagctacttgggaggctgaggcatgagaattgcttgaacccaggaggcggaggttgcagtgagccaagatcgcactactgcactacagcctgggcaacagagcaagacttagtctaaaaaattgcagtgcaatgcaatgcaatgcaatgcataatataaaaatatattgtaggagaaaatatcaagagaacattttttatcagccctccactggatggctttctgcctgcacagctgatgaggtggccttgggctctgtgcactgaggcttcctcaccagtcccccgacttccagggtcgagacttcccctttgatgactgtggcagggctttcacctgcctccccgtggagaaccccgaggcccccgtggaagccttggtctgcaacctggactgcctgctggacatcatgacctatcgggtgaggctgggtggtggcccgtggtgcctcgtcccagatagagccacttccctcccactgttcccccaggtatgatctatgctggctcagctgggagaaggaatggttttgagggtgcctaatgttagttaagagcttcaagaagttagttgtgtctgggggcagtggctcatgcctataatttcagcactttgagaagccaaagtgggaggatcgcttgaggccaagagttcatgaccagcctgggcaacacagcaagaccccatctctacaaaaaaatttttaaaaaattacctgggcatgatggcatgcacttgtagtcccagctactcaagaggctgaggcaggaagatcgcttgagcccaggagtttgaggctgcagtgagctacgatcgcactactgcactccagcctgggtgacagtgagaccctgtcgcaataacaacaaataagttagtcttggtcacatggggaaagttgtaaacccaggtcagagagtgggtgggggcagaccaggtcttggaggcccttgttacttcaacagcacagtatccttgggcaaggagggggcaggtgaaggcctgggccaggcaccagctgtgttctgtctccttccccccacagctgggcccgggctccccgccaggcgtgtgggtctgcagcaccgacatgctgctgtctgttcctgcaaatcctggtgagcctgagactacctgggactgccttccttcgtcacagccacagcaagaagccagctctgcccttcttgcccaccctgcctctgggcctgccccgctgccctattagacgggaagctggagggtgtggagaatgaagcctggtggaggcagggcttctcctgctgtgcctcagtctgtctgtctataggatggacagaagcagccctgccccttctgtcccacagggctctgcggaagaactttgggagaggagggttgtcattctcccaggcgaatgtccatttggcttggaaaccgtatttcccttttagaggtgcccaggtgccgcagccctgggctcttgcttccacctggtggggaaatccgtgccttgggtggaggcccctgggagcctcctgactgccccaccccacaggtatcagctgggacagcttccggggagccagagtgatcgccctcccagggagcccggcctacgctcagaatcatggcgtctacctaactgacccccaggtagtgcccctggggacagtggagccggctggggcagccttcctcctgtcagtgggcagcctcctccctgtcagtgggcagcctctcatcctggatttcctcgcatgttcctgaatccaaggagtttcctccgtggcagtggcaccagtgctcccttactctcgccaaaaatacatttcacaccgaccgcctgtccagtctctgtgcccaggctcagggctgcaaagacctttaaagcctgccctctgccatcatggagtagaaatctcaggccccccctgagaatgccagcaactgccagccttgcgtcctcagctttcctttggagaatgcccttgctgccacctgtggctgtggcctccttccagatcccttcctgctccctccgctgattctgtttctccctgcacatagggccttgttttggacatttactaccagggcactgaggcagagattcagcggtgtgtcaggcctgatgggcgggtgccactggtatggctgctgggcccaggttgcggggctttggggaccttatgggacagggagggagggtctgacttccttcgattccttctagaagcctccaggacaagctagagctagaatctgaggacagggtagccttggaattcagggtcttgtcctgagccagaaagcctagaaccaggcgggcacggtggctaacgcctgtaatcccagcactttaggaggctgaggcgggtggatcagttgaggtcaggagttcgagaccagtctgggcaacgtggtgaaaccctgtctctactaaatacaacaattagctgagcatggtggtgtgtgcctgtaatcccaactacttgagaggtagaggctcgagaatcgcttgaacccaggaggcggaggttgcggtgagcagagatcgtgccactgcacttcagccagggtgacagagcgagactctgaatcaatcccctgcccgctgtaaaacaaaacaaagcaaacctcaaaaactcaaacgaaaaaagaaagcctagaaccagaatgtgagcaagttagggagtgcggttgggaggaggcctagagccagactccgggaatgcttccatcatgaggggcaaggattggagaggcatggagatctgggagtggaccatggcgagggtggagaactgggttcaggagaaggcctgacagttgagggtgtcccagaaggtgtcttggtgggagctaccccaagtaagcctggagtctggctgctggagtggtcagaaggtgacactccctgcctggtatggcactcagcttcatgtggcccatctgcatgtgccctccctgacttgtaccagggcctggtccagggccctccatctctgatccttttggggtcccttccaggtctctggggttgtcttcttctctgtggagactgccgagcgcctcctagccacccacgtgagcccgcccctggatgcctgcacctacctaggcttggactccggagcccggcctgtccaggtgactgggggagggcagctaggtggggcctggcttgggggcgaggcactgtgtgacctcaggccagccacttcccctctctggggcagagtctccgcagacgggactgccctggttcagcctcagaacttgggggctgaacccctgccatgccaatagctgtgcttcttccccttcccctagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatgggtgggtactgcctctcagctccctggggtggggagaccatgggagtgaggaccccaagaatggagctgctcactgcatgctgggccaggcagcccagcacagggactgggcagttctcctgtcctgtgccagagccccccactgagctacctccttccccttcttgtcttccttttgtctcattcctgggctctcccagcctgtccacttttgtttctgtttttttttgtttgtttgttttgttttttgagacggactctctctttgtcgccccggctagagtgaggtggtgcgatctcagctcactgcaacctccgcctcctgggttcaagcaattctcctgcctcagcctcctgcgtacctgggataatagccatgcatcatcacacttggctaatttttctatttttagttggtcaggctggtcttgaactcctggcctcaggtgacccgcctgccttggcctcccgaagtgctgggcttacaggcatgagccaccatgcccggccctaacctgtctgctttctttttttttttttgagacagagtatggctctgttgcccaggctggagtgcagtggcgtaatttcggctcactgcaacctctgcgtctcaggttcaagcgattctcctgcctcagctgcctgagtagctgggattacaggtgcgtggcaccatgcctggctaatttttgtatttttagtaaagatgggatttcaccatgttggtcaggctggtctcgaactcctgacctcgtgatctgcctgcctcggcctcccaaagtgctgggattacaggcgtgagccactgtgcccggccaacctgtctactttctagctgtgttgtgtggctttgggcaggttcctgactcagcttcccctaacaggctcatggccacacctgcccccatgtgtctctgctgctgggaggcagcctggcccctgagtcgcagcaggcatggggttgggttcagtacttatgtctttacagcctatgtctccagcggcagctacagctacatgacctcctcagccagtgagttcctgctcagcctcacactccccggggctcctggggcccagattgtgcactcccaggtggaggtgagacctccctgcccctccggtgcctgctggttgtctggggtcaggtgggatgtggattcccgggaagaaaatagccggcacttggaacagatgacccgagtgcaggtgttaccctggtttacacatgaagtgctggaggctcagagaggctaagtaacttgcctaaggccacagagccagtaagtggccaactcaggattctgcattgagcttgcctgattgagaagctaaaggagacctttatttggggtctgcctggggtgacagtggtgggcctgggtcagtgccgtgctgctgaggaaggggacaggtagggttcagaggtggcccccagggtggcaaggttgggcgtagttggacaggtgggatggaaataggtctcaggctggggccaaggcaggtccagagaggagtctagggtgctgcagggcaggggagcagtaggcctggacgctttgcccctggatgcttggcttgggaggagagctggggcagccctgggcctcgacccccctcatgctcctcctacctggctgcacaggagcagcagcttctggcggccgggagctctgtggtcagctgcctgctggagggccctgtccagctgggtcctgggagcgtcctgcagcactgccacctgcaggtgaggcctgagcgtgtgggcagattggggcgagggtgctggcatcccgcatgtgttggggggtgttgggtgcctgcccacccaggatgcctgccctgtcccccaccagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggaggtaggcagtcaccctgcattccctcacccccatcttcaggctttggggagcccaaggagtcctggcccccaccccactgcggggttctctgagcactggcccgtgggacaggctgtgaggagggtcggatgtagggaggagagaatgagggaggagatagggtgaagataggctgtgagaccagcagagtctccacaggcctttacctccctccttgcatctgctctgccaggtgggctgggtggggattttgttttttttctggagatagagtcttgctctatcaccaaggctggagtgcagtggcccaatctcagctcactgcaatctctgcctcccaggttcaagcgattctcctgcctcagcctcacgaatagctgggactaccagcgtgcaccaccacgcccagcttagtagagatggggtttcgccatgctagtctggttgggtggggttgttgtttttttttttttttttgagactcactctgtctcccaggccggagtgcagtggcgcaatcttggctcactgcaagctctgcctcccgggttcacgccattttcctgcctcagcctcctgagtagctgggagtacaggcgcccaccaccacgcctggcaaatttttttgtattttttagtagagatgaggtttcaccgcgttagccaggatggtctcaatctcccgacctcaactgatctgcctgcctcggcctcccaaagtgctgggattataggtgtgagccaccgcgcacggctgggtgggggtttttatccttatttgacaggctagagactgggattcagagagggaggtaacccgccttgggctgcagcctgttgtggtgggctgggcctggaacccagggttctgctccagatttcaggcaccttggcgggagtgttggggctgcagggctgaaaacaatttcagaaattgctccatggctgggtgtagtggctcatgcctgtaatctcaacactctgggaggccgaggtgggaggccaggagttcatacctgcagtgagctgaccacaccactgcactccagcctgggtgggtcaagtatgttctttgtctgtcttcctgccctcatgtgagcacttgagcagctcctggccccctggccgagtgtctctaaccctttcctgtggcccctgcagccctgactgcttcttcctctcccccagagacagggggcaggcacatatctcaacgtgccctggagtgaattcttcaagaggacaggtgttcggtaaggtggacacccctagggcctctgtgggcctgggcagctggggtggctgctgctctttgaggtgtgtccctcccctgccccagagcagcacgggccgtgttaccatccaggggcctgggtggttttgggcagccggattctctccagtactttcccccgggcagctcccagtctctggctgtgctgactttggctttcttgttcaatggtctgggaaaggatgccaggcagcctggcccccgacctgaattgcccacttatgctacctcggaggagtctgtcctgtccccatgaactgacaggcggctcagggcttggggaagagactggagcttttgcttccctcctgggaatgtgccttctccccacatcagagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccagggtgagtgtgcaggctggtagtgctgcagaatcaggccaggggcacctgccctccctgtcctctgggccatcccctgaggggactaggggaccatgaggtgctcaagcagggaaggggcatgctggagtttacttttaggattctggaaggcctcatccttgtcaatggggtttggtctgaggttgaggcatgttcatccttgtcagtggggtttggtcagaggttgaggcctggcagctgagctctaggtcctaggcacatcggcaaaccctgcgtgttctgtactgggtgccaggatgtgggtgcagagcgtggcgaggggacagagcccccaggggacatggtcatctctgcatgaggtcccaagcacacttccgggggctcacagccttagcctcctaggctgaacctcatggaaggtcccagggaccgtggacatgaatggtattgaagccactcacccagagccacacggctagctggtggtgaggctgagacctgagcccaggtggtttgagcccagagcctgagctcttcaccactatgggtgtcctgggtgggggtgaagagacacctatgggctgggactggcaagacgagatgatctctgccaggcagagagcaggagtgcagttacagtcaaagatacattgtgggcaaaagccaggaggtgtgaggggtctggcgcatttagggactgttgagtagcctctcgtgaaagaggattttgaagacaggcctcctcccctgccacccccaactccttgtccctcagttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggtgtgtactaatggaggtcagatcccttggataagccccttgctgtctgggaagtggaccctgatggaggaaacccagagagaggtggggctcccttgggtaccccgggacagtcaggtccccaaagccaggcaatctgcccccagcttggggctgcatgccaccatccctcccccttctcttggcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctggtgagccccttgtggcaggtggggttgagggtagctgccccagagccaggctggcagcttctgtgaccagcttgagtcttgccacactgccatagggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggtcaggcaccctgggacctctgcaggtggggctggccagctgggggctcggggcagaagctagagactgcaggccagtggggtctggcctgagggccagccagtctggctgaggagcctgaagggaaggaaggggctgggagtcaacctgcaaagatgacacgtgtccctgtctgggagcccagaggcccttttgtggcttggggatggggccagtactgctgctgggcttttgtcccaccggatgagtcccgcactgggctgggaagtccagggtgggtgggtgcctgcgtctgcccatcgagactgaattcctttctcatgcctgtccttctgcaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggtgagcgggccctgcctcctgctacccaccgactgttacagccctccagccttgcctgtgatcccccttcctggcctctgcccttagacggagtcaggcaggcctgggcagggtggaggtgtttcatgtctgctctctcctctccgccctgcaggcaccagcagcatcctggcaggcactgccctggctgccttgcagcgagccgcaggccgggtggtgggcacggaagccctgatccacgcagtgctgcacctggagcaggtgctcaccactggtatgtgactgccctggagttggaggaggtcactgacactttcccaagggcccgcggggggagtggggctcccctggatttgcatgtgattggccaacagccacaagactgtgctgctgttggaaatactttccttctagtcactttgaccttctctggtcgttttcaacctgaaatgttctacctcccaacgagccgtttcacaagcatctactgagtgccagattctgtgctgtgccctttttttttttttgagacggagtcttgctctgtcgcccaggctggagtgcagtggtgcgatctcagctcgctgcaagctctgcctcccgggttcacgccattctcctgcctcagcctcccgagtagctgggactacaggcgcctgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctgtgctgtgcctctcatgcttgttggaaccaggtgctgtgcttcgtgactgtgcctttccagggctgtgctggggtagggctgggcagagctgctttggaccttccgcctgtcctggcatcgtgcccttacttgagatatgatcacctgtgcccccgcccccaccccctggccatatggtgggacagcaagagcccaacaatgactatgatctaatgaatgtcaccagcgccaggcttctcactcctcctggccaccgagccccctggaacccatggccagtgtagagcagctacagcttgtctggtttcaggtccacctcagggtgtcaggtcccgtctccagcacacccctggaaagaaactgctgcaaaggcctactgaagcctgactgtggtgttttctgtcactctgcagctcaagcctcacatttcactgtagtgactcatatcccataatcggtagtcattagcaaaaggagcagatggggaagcattttcagttttcttttgaggtgtaccattcaagttctacatttggccaacggaaaactatttgttgagaacccactctgtggggccccagggataaaatgagcaaaaatggggtccctgccctcaaaagtcctgtggtctcctggagacagacattaatcaataactactcaggtgcatgtgtattacaaactgtgccaagtgctttgaagcagaggggcacagttaagtcttgacatttcaagacttagccactttgcaactaccaggttttggctgcaaagttccagatggcttctgtcttttgcatttcatactttaaacccttgcaggcccttccctaactatcaagggcctgtcccagaagcaactcaagttttgttatttttaatttttttttatttttgagatggagtctagctctgtcacccagattggagtgcagtggtgcgatctcagcccactgcaacctctacctcccgggttcaagagattctcctgcctcagcctcccaggtagctgggattacaggtgcctgccaccatgcccagctaattttttgtatttttagtagagatggggtttcactgtgttggccaggctcgtcttgaactcctgacctcatgatccgcctgccttggcctcccaaagtgctgggattacaagcgtgagccaccatgcccggactagttttgttatttttatgcagctacaaggaggaaaatgatacatacctttcattactgaagatggaaagatgtgtaagttagataagagaaaaacagatcctgatgaccttccttccaacataaaccacctgtcagaagacggtgcagggagactcaggccaaagggaaggtatctgtcagcctctcctctgactaaaactcccctaggaggggcagaggtcagtgtaaaatatgtattttttgagacagagtctcacattgtcacccaggctggagtgcagtggtgcgatctcagctcactgcaacctttgcctcagcctccctagaagctgggattacagggcatgcaccaccatgcctggctaatttttgtatttttggtagagactagatttcaccatgttggccaggttggtctcaaactcctgacctcaaatgatctgcccgccttagcctcccaaagtgctgtgattacaggcgtgtgccaccgtgcccggccatagtgtaaaatctttattcttcagtgtggtttatcccaattccaattatacattaggtctaaaacaaaactcaggccttgggaattccaagctttgccctagagtgaagcccattcccttgctgggattgttctggggacagaagctgcatagctcactgtcctgtggagttgagggaagctatctttccacactggtcccagcaaggggtgcagggccgggagcctaggctgggagagtgaagctgggccagatagactccaacagtgacagtccctgggctcacaggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggtgagctctggccccagcatgagggaggcaggcagggggcctgccagctgggcctgggtcctcaccaccccttctcctgccccgtccgcaggatgtgctgaggagctggtatgcccgacttcctgctgtggtgcagaatgcccacagcctggtacggcaaactgaggagtgtgctgaaggcttccgccaaggtgaggggcttcctctgggggggtcagggcactgggagcgagtattctgtcacttgtgggtttgaggccagggtcatctgcaggcttggcacaagctccagatattcggcctctgggaacagaagcctactgtctgtcctctccagggtctcacatttaggggagagctacatctgaggacaaaattttcatcatgggaaaggccctccagccctaacaggaagcagagaggggaagggactcaacccatggctgagttccaaggaagtctgagctgggcagggtccccagtgtgtggcttcacagctccctagatgccgactatgctgggtgtggtgttggttgcttcctgcacattggtcctcaggcagtcctgggaagtgggttactcctggctccagccggcactggaatccggcttctttaccatgacactggctcagcagcacgtcttggcacttcatgcaatctccagatgggtgctgagtatcttggcccaggcacgtcactcccctctgccccacctcaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgaggtactgatggggctggggttggtaaagagacctctgggggcaagagacctcactgtggcccaccagttaaccaggggctatatctgtaagtccccctggtcctgcaggcccagtccagcctccagaaggcctgagatttgtccagagccttctaaatacttcctgtcttgtccagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgcaggtggtcctcgtaaagtcacttttgctcctgctgggagcagttcccacttctctacaccatggggaactggccctggggtgatccagcttgtggtgctgggggcccaagaggggcacgagggtctgggactggatgggggctcctgccatcatgtgggccccggacacagctgtgtgctgcactgtgtgtgggagcaggctgaggtcttgggttttaccttcctatttcagtgcaactgatagacctgccctgccccatagcatctggccctccctggtaacagcacactggcatctctccaaggagtagctttattcagggatcataaacatcacagcctctcctcaaagtcaagcctaactgctaggtccccagatgtacccaagttgtctaggactggcaggggtagcttgtttgctgtagtgtttgagggcaagagactgaccatccatgcagaaagctggcctgggctgctcgctgcctgccgtggctttcccacctcattaggagcccgcttctctcggtggggagatgctgcccccagagcatcacctggccaggtctgagggcagagcatggagtgggtccagactttgtttctctgctgccagccgtagaaaggtctgggctgtcagatctcccccaagccagacagcctcgctcagctccttggctggggccccttagggaacaggcctgcaagtgtgatgagccaggtgtgctcatccaggcagctacaggcgcagcctcttgatatcttcactgcggaagtctatccgcagggccagcacctggcgcacttcagcaggggtgaggcgccacgtcaatgggccggaattgggtccccagtaatcgaggatctcggtcacctgtggggaaggacatagagaccagtcagcaaggtggggttattctgaaagagggctctggcctctaccaggggcagagcaggggcacccgggaaggggaaggtgtcctatagagctggctgctggcagacatggtttagagggaagtggcggggatccatctttgcctctttcagtcacccctccctggctgggccaagggtgccccacctacccgctccagattgaggatggtggccatctgggagagccgggcaaacttgtctcggatggtccaggtggtcaccgtggtaaggtaggcaatgagcgacctcagctccttgtcaaactgcagaccacccagctgcaggagaacccaagcccagtcactacttaggcctggccaagcagaactggcctccagttgcccccagagctgggtggcaaggcccgccaggcctcaggtggtgccctgtggtttgtttgctctacggcttcagaagccagagcaggactggacccagacatgcagggcctgtgggcagcagacagaggggatgcaagtcctgggggtggtggcatgacatgtcttcctcagaggagaaacgagagccgcagacccatgacccctttaccttacccggttaaaggtggatttcagcaccactttctccaactcgacggcaacaaggctagtcatgaggccggttaggctgtcgtagatgaccggggacaggctggcctgcacacagagggttgacatcagccgagccccacctaactcctctgcctctatgctggagtcttaggtggtgaggatagtagcgtgaggccacgggggagtttctacaggtgagggttggaagggctttcagggtccccagaaggaatgtgatgagaccctgcaggctgctggtttgggctgacgtgggtaattccctaagtggatccctagggcccctgctcaccttgaactctgccatttgctgctccaggttaaggatgaactgttgtacccaagggtcgttggcctcatagtcattgaattcttcctgttgtcaggaagcagggctggtcaccatgggcctcataagaagtaccattcattgccacccacctctatccctctaagaaaataatgtaaaacattcttccttccctgtgccttctgactcatctagtttaaaaccagctcagacacccaggctggcagaaactgaccagcaaacagcccagggctgtagcagtggcccacataacatggtaaagttcctggcattttattccttcttggatctcttgttctacaggaatgaaatcactacgccaggaggaaaaaaacgcttctaagtctatcataggcggggcaaaaagagctccaataagggaataagttaggtcaaggcaaactccatgtctttctgagcccttctgactagggacaaactgtttcctgggaggaacctagtcttcatgggtcagggtgggggaagtgggcctgggaagcatggaaggtctagtctgttcagatggctctgctccctctagctggggctagggatgaggggtcatcggggcttgatggctgcctgtggccaggctaacctcctcgatgttgtgggagacggagaaaaagctgttgatccaaggctgcacctgtggcttgatggctgtgctgttgagctccgtcagcccttcctgcacaaggacaaggtggagacatgtgacacagaaggcacgactcatcccttccctctctcttctccccatcccttccctctatcctctccccatccctttcctctcctctccccatcccttccttctctcctctccccatttcttccttctctcctctccccaccccttccctctcctctccctaccccttccctctcctctccccaccccttccctctcctctccccactccttccctctcttctccccaccccatccctcttttctccctaccccatccctctctcctctccccaccacatccctctctcgtctccccaccccttccctctctcctctccccaccccttccctctctcctctccccaccccatccctctcatctccccaccccttccctctctcctctccccaccgcatccccttctcctctccccatcccttccttctctcctctccccaccccatcctcctctcctctccccatcccttccctctctcctctccccatcccttgactgcagggcgttcttccagccctgaggctttctgcaggccctgttggaggttataacagagctagtgctaatgaaaggaggagccaggaacatgcccctttccagatctcagctgattcaggtccagggtaacgatgaggccttgagactgttctgataaactctcacaagagatttcagaatgctcaatgttaggcagcacctgcggctaggtcagaacaaccatgtggctccacttcctctgagcatcttctgagagctcttgtcattgtggggccaagtgcaaagtctagagcaccagatgttggcttgtcagtgtgacaacttcactgctgagaaaccaacagggcctttagtctcaagggacctgcacaactccaggctccagggcttgcgtgctgctccctcacccgtcctcctggcttccttgcacacgatgagccagctaacaatcttctcagagcaacacacaggcacaggattcagtcagcagttgaacctggggcttacctgcaagaggtctcggaatttgttggacacggcggccaagtcagaaaggcagctgtcaaacttggcctgggcctgctcccctccaatgccctggctgaagagcttggtgcagtcactctaggggagaacactgctgtaagaccaccgagcacgcgtgggccatgggagtgtgaggagccaccagccagttctactcctccagccagctatggcctgtcaagagcccggatgggtttcagaaaacctggattctatcctggtggttatccacttggctcccacttccccctctgtaatatgggggtaccaatgtcggggaagtgagtaagaaacagaaataccagaaagtttttcctgtctttagagtcagacattcctaggttcaagtcctggctcagtcatgtattagttgagtgaccttgggcaaatgatttaaagtttctgagcttcaattttcctgtctataaaatgggaacaccaattcctgctcctcatgtatgagatgaagcacaacgtgcctagctcaatgcctggcacaggagacactagctattattgctatagttcctcctttcccccccttttatatttatttacttcttcttaaattttatttaaatttaccaaaaaaccacaaaagtcagtttctgcttcttaaatattttggtatggctaccaaaggggatggtcaagatcatagctaaggtttaagggcgtactgtatacctggctttgttctaagcatttcacttttattaaagtaccaggctgggcgaggtggctcatgcgggtaattctagcactttgggaggccaaggtgcaaggaccacttgcggccagagtttaagaacagcagggaaacatagtgagaagccgtctccacagaaaattaaagaattagctggatgtagtggtgcgcccctgcatccctagctactcaggaggctgaggcgagaggatcccttgagcccaagggttcaaggttgcagagagctatgactgccactgcactccagcccgggcagcagagtgagaacaaagtacctattctacttaaaaacaaaacaaaatgaaaaccaaaaaacccccacaactattgtaagttactttgaccttcataaaaaaaagtatctcctttatgaaataggtaaaattattatccccattgtacagatgagaaaactgaggcacagaagttaataatttattcaaagccatggcaataagtcaggaaaggctgagcatggtggctcactattgtaatcctaggactttgtgaggccaaggtaggaggattgctggagcccaggagttcaagaccagcctgggcaacaaagtgagaccctgtctctcttttttttttttttttttgagacagtctcactctgtcgccctggctggagtgcagtggcatgatctcggctcactgcaacctccgcctcctgggttcaagcgattctcgtgcctcagcctcccgagtagctgggactacaggcgcctgccaccacacccaactaatttttctatttttagtagagacagggtttcaccatgttggccaggctggtctcgaactcctgacctcaggtgatccacccgcctcagcctcccaaagtgctggatttacaggtgtgagccatcgcgcctggcagagaccctgtcttttaacatagataaatcatggagctgggactctaggccaggtattctgactccaaaaatcctgttttttttgttttttttttttttttgagacagagtcttgctgtgtcacccaggctggagtgcaacgacatgatcttggctgactgcaacctctgtctcccgggttcaagtgactctcccacctcagcctccggagtagctgggattacgggcacccaccatcatgcccagctaattattgtatttttgtagagatggggtttcaccatgttggccaggctggtcttgaactcctgactgcaggtgatctgcccgcctgagcctcccaaagtgctgagattacaggcgtgaaccaccgtgtacggcccagaatgcctgtctttttttttttcttttgagacggagtcttgctctataacccaggctggagtgcagtggcttgatctcggttcactgcaagctccgcctcctgggttcacgccattctcctgcctcagtctcccaagtagctgggactacaggcgcccaccaccacgctctgctaattttttgtatttttagtagagatggggtttcaccgtgttagccaggatggtctcgatctcctgaccttgtgatccgcccgccttggcctcccaaagtgctaggattacaggcgtgagccaccgcgcccagcccagaatgcctgtttctaatcaccacactacagcgtaggtgtagagacctctccagggggaactgcctgaaactcatgttttgggttgccaggagctgccgcattgctcgtagccttcttagaaagttcatgctgttttggctccagaggggaagcagagtggaagaactaagagggactctcctagcagacaaaggcccttcactcccacagtattcctgacacttactgtctttgagtagtcttgtaaccttccctgtaagctgaacgtcatgccacctgatctgcctatctcaaagggctgctgatggggctaagaaagaacatctgtgaaatgcaaatctaagggcagctgggatttacgggaataggtttttcagctattttacttggctaattctaccagctcacttatgaatttctaatatttccccaaattttacttccaaaacccaacagactcatgttaaggatgaggtcagaaatagtctaaagtgccatgacttacaaacaatgatgtcggccgggcgccgtggctcacgcctgtaatcccagcactttgggaggccgaggcgggcagatcacgaggtgaagagatcaagaccatcctggccaaaatggtgaaaccctgtctctactaaaaaatacaaaaattagctaggtgtggtggcgcacacctgtagtctcagctacttgggagctgaggcaggagaatcgcttgaatccgggaggtggaggttgcagtaagccgagactgcgccactgcactccagcctgggcaacaagagcgaaacttcatctcaaaaaaaaaaaaaagtcaggcatggtggctcacacctgtaatcccagcactatgggaggctgaggtgggcggatcgcctgaggtcgggaatttgagaccagcctagacagcatggtgaaacctcgtttctactaaaaatacaaaaatcagctgggcatggtgtcaggtgcctgtaatcccagcaacttaggaagctgaggcaggagaatcgcagaggttgcagtgagccaagatcatgccactgcactacagcctgggcaacagagtgagaatcggtctcaaaaaataaaaaaataaaaataaaaaaaaaaaaagacaaggccaggcgaggtggttcatgcctgtaatcccagcacttcgggatgccaaggcgggtggatcacttgaggccaggagttcgagaccagcctggccaacatggcaaaaccccatccctactaaaaatacaaaaattagctgggcgtggtggcaggtgcttataatcccagctactccagagcctgaggcaggagaatcacagaagttgcagtgagctgagatcgcgccattgcactctagcctgggcgacagagcgagactccgtctcaaaaaaaaaccaacaatgatgacagccaacttgttgaacacatacgatgtgacagatactatgttatgttgtacaagtgttcactgtggaggcagggccctggcctcacttctttcccagaggctgagtttgggagtggggaagaactgggcccccctcattttccaatagttcacaaagtgatccctccatgctgttatttttattttgttaattttaaatttatttttactatttttacttttttttttatgtttttttgagacggagtcttactctgttgcctaggctggagtgcaggtgcacgatctcggcttgctgcaacctctgcctcccaggttcaagcgattctcctgtctcagcttcctgagtagccaggattacaggtgtgcaccaccacaaccggctaatttttgtatttttagtagagatggggtttcactatgtttgccaggctggtctcaaactcctgacctcaggtaatcctcccgccttggcatcccaaagtgctggggttataggtgtgagccaccacacctggctattatttttaccttttttttttcttttgagatggagtctttctctgttgcccaggctagagtgaagtggcgtgatctcgactcactgcaacctccgcctcctgggttcaagcaattctcctgcctcagcctcctgagtagctggtattacaggcgcccgccaccatgcccagctaatttttgtatttttagtagagacaggacttcaccatcttggccaggcttgaatgcctgatcttgtgatccacctgccttggcctcccaaagtgctgggattataggcgtgagccactgcgcccagcctattattgctttttaagtgatggggtctcattatgttgcccaggctggcctcgaactcctggcctcaagcaatcctcctgactcagggtcccaagtagctgagactacaggcacgagccacccagctattgttattttgagatggagtttcgctcttgttgcccaggctggagtgcagtgacgcaatctcggctcactgcaacctccacctccggggttcaaacaattctcctgcctcagcctcccgagtagctgggattatgggcacatgccaccacacccagctaattttttttgtatttttagtagagacagggtttcatcatgttggccagaccggtctcgaattcctgacctcaggtgatccacctgcctcggcctcccaaagtgctgggattataggcatgagccaccacacccggcccagctactgttatttttaactgttaatacaactaataagtaccactgcatgcctctcatgtactaagtggttcatattaccacattcctctcataacagtcatgtggcacagaggtcattatccctgctttatgaatgacaagactgaggttacagaacttttgcctaaggtcacacagctgggcagtggtcaagtgaagatttgaacttggggtatctggcttcaaagcccaagcaatttccactatactctgcttccttcctctaaaaataacagctactagctttgtataggattaggcaaaccttatcttaatctcctacatttatacagggatttgtcatttttataaggtgcttttgatcctgattttttttttttttttgagacagaatctccctctgtcgcccaggctggagtgcagtggcgtgatctcggctcactgcaacctctgcctcccaggttcaagcagttctctgcctcagcctcccgagtagctgggattacaggcgcctgccaccatggctggctcattttttgtatttttagtagagatggggtttcaccatcttggccaggctggtcttgaagtcctgacctcatgatccacccgcctcagcctcccaaagtgttaggattacaggcatgagccacctcacctggccttgatcctgatttaaaaaaaaaaaaagttttttttttttttgtagagatgaggtctcaccacattgcccaggctggtctcaaactcctggcctcaagtaatcctcctgccttggcctcccaaaatgttaagcttacaggtatgagccacttggcctcaatcctgttttttcattaggctacccaagaaacacaagctagggctggatggagctatgcatctcatttcgtagatgagaggactgaggctcagagggctaagggacttgtccaaggtcacacgccaactatgtgctggaagatctaatttgtgtgttattttgagatagagtctgctctgtcgcccaggctggagtgcagtggcacgatctcagctcactgcaacctctgcctcccgggttcaagtgattctcctgcctcagtttcccaagcagctgggattacaggtgtctgccaccatgcccagctaatttttgtatttttagtagagatggggtttcgccatgttggctaggctggtctcgaactcctgacctcaagtgatccacccgccttggcctccgaaagtgctgggattacaggaatgtgccaccgtgccttgcctggaagatctaatttgaattctgatcttccaactcctgagcttttctccctggtccaaggatgccttgctatcatgtcagtcaccaaagaatcccctcaagtgtggctcaatgtcacca

SEQ ID NO: 122 - DNA, 11949 bp, Homo sapiens
  source 1..11949: mol_type = genomic DNA
tagcgccagtaggccaataagatgcacacttatattctagaacctgtgaaagaagtaatagccagaaactggaaaataacagtcaaactcttaaaaaaatgcctctcagaacacagtcacttacaccttttcctctggtagttctcttcagcaccaagtttcctggaagaacaagctactccccagttttcttaaagaattgtctgattgtattaagtaagtggcttctggtaaaataatggtaagagaaaagctctggcattctcttgatcactcatcttctctgccttcctccctagcaacatctcctggcctcagcctgtgggcttcagcaacaccaaactccatgttgctctctgacaagcccggccgtctccagttcttgggctttatttcctcgggggccctctgctgaaattcccttccccttgctgtattagcacctcctacccgccttcaacatgcaggcactgcctcctctaaggagccatctgtacttacgtagctgtgagcataggatggggcatacagcaggcacttaacaaatacttgtggaatggaaagaaactaagataggatcaaaaatacaaatcaagatgtgagagaaagacgatcaaaagccctcacgagggggctgggcgtgatggctcacacctgtaatctcaacactttgggaggctaaggcgggtggatcacttgagggtgggagtttgagatcagccagagcaacatggagaaacctcgtctctactaaaaatacaaaaaattagccaggcatggtgatatatgcctgtaatcccagctactcgggaggctgaggcaggagaattgcttgaacctcggaggtagaagttgtggtgagctgagatcatgccattgtactccagcctgggcaacaggagtgaaactctgtctcaaaaaaaacaaaaaacaaaaaagaacaccacgggaaaatcaagtgtgaagcaagagctcaactcttaacaggggcaatgtttggagttttgttactggaaaagatagagaccttaccaggtccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtc

SEQ ID NO: 123 - DNA, 860599 bp, Homo sapiens
  source 1..860599: mol_type = genomic DNA
aacgactttcttttaaagtgccaccatttgctcagttcaatttcaccattaaaggacaatggccaattttctgtggacctgggatgtcggttttgtctaaagcgtgagcgtgtggggaatttactaacctggctgtgattgcccatgaaaacaggttatttaacaggatttaaatactgtgctctgaagctcaacagcagtgaggaggcagccggagaattggagtggcgcatttcccttccagcgctaatgagagaaggcaggaaaagcgagcgtgatagataagaggcgggcggagagagacaagacagaactagggccaaagagatgggtgagggaccccaatcaagagacaacgcctgcttttaaaaaggtgaccttaaaattcagtcacttgttcacaggttttattcaacaagtgtttgttaaagggtctgctgggctcaaggttctcaggtgccatgaaaaccaagcccgctaccaatttttgcaggattcttggaggaggtgttttggagccgatttttaacttaattttttgatgcttctgccagtcgttccctgccaaccttctgaactctccctgccttgctggcttgctaagtgaagccctgaacagaatatggggatgagtgtcaggaggttggtccttccataaactgactcgaatcttcgattacggtgtggcctcagttttctcatctgtcaaatgggagtcattatacctaactcacgtcttcaggcttaaacaagagcgtaggtaaagattctgacacaataccagctacttgtgagatggacacagccgccgtttcctttttcttccctcttgacatttgccaggctagaatacgtcctttctaaaattttgcttaggggtgtgtctcttccagaaagtcttccctctacctaggtgctattgaactttggcatggccctgcccttcgcagcacagggcggtgtctaagagtgagggctggggacgggctttgagattcacatcttggctcccgggctcacctgcagtgtgatagtgaatgagatgtttatctctttcaattctcagtttctcgttagaaacagtacgtgctctgtagggctgttagggttaaatgaggcagcccatataaaacgctttcctgggtcctggcacgtagtatgtgttcaataaatgacagctgttacccatcatcctcatgaaccatgaccctgatcaccggtggtttcctagaggactgcaagtctattctacaactgccattaataaagaaatctttcttcttatttgaaaaacaaaagcaaaacacccctgcccaaacccacctcagtgaaatgctgcctgcctcctctgcagagtcctgccccttccaagtagaaagaattttacttccaggcttaattcgcccaattactccatccgttacaacttactcctctcctctagtgtacccagagtctttgaagacagactgtactgggtgaggaaacagaaaatgctcaattttctatacaaacggcaggaaagaaacactttttttccactgggcttgagaatgaattatgtgacctctctacaccacaacctgtctcgcttattctgttttgcttactctaatttccaaacggcttttcatttcctgcgtaagcactgtctgagatagacggtgggggactggacagagaagggtgggagttaggggaggaggaagcagtagtggctgagcagtataattcccccacaacacattttccaaacctcaaatcaggacccggagccctggaagatttgcgtgcaagtggatttgagagaaggcaatctaggagacattgtttggttgctgaaaatattgacgtttctatggtttatgagaacaaaggaatagaattcttgaaatcagagctgttctgaaaagtccagggagtgtggtgaccgtggtgggtccagggaatctcatcttgaattttaagtttgctacaaaatgaaagatcagaagtgaatgacacgtcacagtggcagtctaggggcacctgtaagagctgagcttattgtatgatatcaggttttctgttatagtctctcactgccccaaacatcgactatttgtcattatttatcgattaacggtcattaattattggcatgctattttcctaatggtgctccccccgcctccccatcgctctatcctgagctcctgagtggggttgtgcctgactactgtgttcaacatcatgccgttaggagatgctcagtatacttgttgaataaaatggacacaagtgtattcctgaaacatgctctttaccttggtaggaagtgaccagaagagtcagcaccaagaaatcttgctgtccacttgggcccaccagcggctctccctgcatacctagccaccagactggaggaaaccagcagtagttgtggattggaccccacagtcagccccactcaggactccagaagatgttttgtctgtttgctgtttctggtgtgcggatgcttgtttagtgttctggccagccactgccccacccagactttaggcacctgtgtggccattgcctgggccacacgggagctggtgggggcagagccctcagtgtctgtcttcctcatgtcttttccttccctgtcggatacggtttggctgtgtccccacccaaatctcatcttgaattgtagctcccataatttccatgtgctgtgagaggaacccagtgggagatcattgaatcatgagagcagtttccctcatactgttctcgtggtggtgaataagtctcaagagagctgctggttttataaggggaaacccctttcacttggctctctcattctctcttgtctgccgccatgtaagatgtgcctttcactttctgccatgattgtgaggcctccccagccacatggaactgtaagtccattaaacctcttagtctttataaatttttctttataaacccagtcccaggtgtgtctttatcagcagcgtgaaaatggactaatacactctccctggatcacattaacaccttctccccctggggttctggcctcctctgggtcgtgtccaacatgatctgtcagtctctggtcaacagtgattttccaacgtgccccgtgttgggaagagatgaggggaggaaagtgtggatcttaaatatggagtgggaagagggaggagggagaacaaaatatatagagttacaaaggagagaaattatattatgacatggctatcaaactattcaaaagagcaaatctgtagtaatttgtgtgtggttttgtttttttgttttttgtttttttagacagggtcttgctccaggctagagtgcagtggtatgatcttgactcactgcagcctcaacctcctgggttcaagcgatcctcccaccttagtctctcgagtagctgggactacaggcacatgccaccatgcctggctaatttttgtatttttttatgtgtgtgtagagacaagattgttccatgttgcttgggctggtcttgaattcctgggctcaagtaatccttccgcctcagcctcccaaagtgctgggattacaggagtaaggcaccaaacttggccgatttgcattttaaaaactgaatatctgttcatttgtgtgctcctttattaacatgttaaatagcaagatttagcagcaggtctaacaggtctaatggctaccataatttcaaagtagtgatgagcagaaacaatattttgagatatctacgacaactaaaatgtaatatgaaaatatctgtgttttccattggtgcaaaagtctcggttgttgctaatatttctgtggtttgttgtccatcttcataacagaagtaaatgataacttttatttgaggccagtgagaataaggatgtattattctccacccaagtgtgcagaccccttgaattctgtcatggactctaaggtagagctcacattaggttggtgtatcttttgtgctttgtgcacagaggtgtccgctttcttactaaaataattcccaagtcacagagaacttccttagcctcaagaggctgtaggaagtatgtatggtaggagtgagggaatcaccattttcaccagggaaaaatgaatagttaacctgtttggttcaaaacagataccaattacttgaggctaaagtcacaggctgctggagagctggtctacttccaaacggtataaatatttaagtccagagccacaagcgaacggtgacagaggacctgtctgtctctgtgcctgtctccatcagctccctcactggctcccctgggacccttccctcctgtgagcccccatgtcccaaggggtgctagaggcttcagcactgctggaaggggacaaatttgtgttctcctgcattcttcttaaagccatgcccatgtcaaagcaacgtatagaggctcagtgaccaggaagactttattcttagtccagctttgtcaccttacacccaggtgaatctgggccctggaacatcaagaggcttgcccaggtcgcacagccagataatggtgggcgtgactctaaaccatgtcacagcatgccctccagagctctttccaatccaccttcgagaaactgggaagacccctgaaggtcatgggggttgggcagcctgtcccctgggctggctgtctctcctggccccctgctttccatcaccagggtagtttaattcatggccttttgaggcccccgttctgtctgctggggaacagctctactgccagcctccctcgggctgtaggccaccatggaggatagcaggagtctccacctccctccaaggtgacagctggaggcagcagcccacagacaagagtccgctcaatcccagccctcttcacttggctgccagcccagcttggctctgcatcccctgggagccagccctccagcccaccctggtaccgagaaagggtagatggactcaggtcacaggacatcagaggaggcaggcagtggacaacagctgctcgggaggaggcactgggcactcagggtcccgaggctggggtaggggtggaggtgtgggtgtggggacagtgccagggaagtttggcactacagtggagcaaaagaacagaaggggaagaggagttccatgcagttgggcatgtcacataattacaggagaaaaatcaggccagagcctggctctctctacctctgtctgagtgatcatcacccttattataaagcaactaattattagtctggctcattagcaattataaatctctaactccagaacttcatttaaaaaatgaaaagttagcacttaatgattttcctaactgcttagatcatgcgcagagcttacacatgcagctcccgtggttcctgggagcggggctggccttcaggtactggggaggggtccctgctttcccatccagaaacctggatgtccccccagtggccggaaatcaagcgctctgagatgtgagaagtggagaaagagcggtgaacttccttctccttctgttttccagtaaaaatagaaacaatgtgtttattgagcctttctgcgtgccacgtgcttggtgttgtgatgccttatttcatttaaatctccccataacctgatactgttcatctccattctattgatgtagcacttgcagtcatggcacctgccataggatcatgagctggatgacacccaggttgccctgacttaaccactacccttaactaagcccctacccttaaccactaccccatgctcaaccacagctctccatggctctaatgagggaagagccttgggtagattgatggttgtaccctttgcaaatgctccctaagattggactgctagagaaaggtggcctgttagatcctggtgtgtcttgtgggtccatggtgtgtgggcaggtgagtggatggagggaagattccttcccagttactaggatggacacttttcattatcctgtggctctttaaggcttttctagcctcctcatcctgccccaaacttttccaattctttgctacttcttccgtttcttgagcactcactgaaggttggaacaaagctgaagaggttgcatgaggaaggccctgttccctcaggcagcccttcccttttctctttctttcttccaggtggaggggaatggctggagccaggaagagctgcctgagagccacaggcaaaggtgggaggcgaaaggaagacagagcatggatgctcaggcccagaagttggaggaaacacccacctgggcacgtgagacccccatcaaagcagcctagcaagacaagatgatcccagaacaagggagggcccttgggttcaccctaactgtgtgcatttgacagtggcagtgtcttcccacctgtgaaagtaaggggtaggggttagacagttcttccagctccggtgttggtttctgtaaagaaccttctggtcccgaggctggggtgggggtggaggtgtgggtgtggggacagcaattcaaacagacagtccccatccctacagtctgagattcacaaccttagttggaagctgtaactataaaatacccaaatcacaaaacttaaagaaatgaatgacttatatgactttgtgtatttctacagagaaaagggaagatagccattagatagaagagtggacattagtgactcatgcattttgtcaggggttcaaattccgggtctccaagtgacaaggtctaaaaaaatctcagagtggaacagattggagtacatatcatcagatgtcttgaagatgtggcatggatagagcctgttcctctcatcctacaaacccaggaaggcttcctggaggaagtgacctccacatcagagccaggtcagcaggcagggcagctagatagggcaggtgcccaaatgccagctcacacagctcagtagaaatcactggaatactgctagagatcctggtgagggtgaaaggaatcttctgatgagcagcttgggggatgcaaaagtcctgcaagtaactgcactatcctccttgctctccaaggagagcaagaatctgagcatctcagagcagaccaggcccttccagcccagtgtggggtagagagcccagcccccttgctctccaaggaggatggtacagttacttgagggacttttgtatccccaaggggcagaaagtctggggtcaaggacaaatgaccaaaagcttagggctgacacacatggggcacttcttaaatgctccacgtgcattcaagtcacttaactcaaatattatcctcattgaacagatgcggaaacggaggcatggagcaatgattacatagcctgggaatggaggaggcaggatttaaactagatggtctggctgcagggctgtgtgaccttcacatactcatactcatactgtcctactcatactgtcagtatgacctactcatactgtctctggatgaagaagttgtgctcaccctgagggaagggcaaaggagggggctctcctggcagaatattggtttcctactgtgccccacactaacctatagcccagtggccacattcctcccatgagatgctcctgggacagcaagaggtccctggaggagaagtgagcccctggtgggtcccgaccatgtggtacctgtctttgaatccccacctcccaacagtgcccagcatggcctggtggcactgatgccatggagcacagcatcctctactgaccagaatgggaacatgccccagggagaaacccaaaccagaaggaagcccaagctaattaggcctccagagtcatatgattttagagagaggctccaaggaatttctggggccttgagaacaaggagggagcaggaaaagagataaagacaagatgactccactgatcctcaaagacacatcctaagttcaggataaacaggcagggagggtatcccagggtcaagtcccccagcccaggggtgcccagactgtcttggtggagtagaaactttgtatgtttcagagcccgaggacagctggagtggctgattgtgatgctcctgagtggcggggagtgggtagctggtgttgatagttgagccctagagcttggggcacacgattaagggttgagatgggttaacggggcaccaatgggggaacactaagaagaaattctgactcagtccgggtcagccctgtggtccaaagcaaatggatcacctctccacctagtgagctccctgtctactgaggtattcaagagaggctgggcgacccctggcaggaatcaagcactaggtggaggtaaggctaaaatgtaattaccatcagcctgataaggtgggtctccttcttaacccatttttccctaagaatctgcaggcacagagaggttaagaaactgcttgagatcacatagggccaggattcccttcaggctgcccccaacttcagagctcttgtgtttagggccacccttgcttcacctctgtatggcaacctcacactgggctggaaggacctggtctgccctgagatgctcagattctgttagaaaagcccctctgcccggggaccccagaacctttttgctccctgcacgaccccccaagccttcaccccaagcctctgtctggattggccttgctaggatagaggcctagatggcgttctcttgctgagggctggtcagaggccagcagtgctctgtcctcccccgctcccctctggctgcccatggtgtggccctcacagccctgggtgcccctcccagccaactgattttctatgaaagctgtggcaagtgacggcttcttgcctgggaacagcacctctcggcaaactgacaggtaattggcccctaaatcccccaggagacacggggaggatgaggaaaaattacggctgtggaactgagtcttaaaaattatatcacctttgctgacagtgtaattactcctttttctcaagatttagtgcagatctccaatccttaaacagttgagggatattttaagggttctccttttctgttcttcttttccccttggcctgcagaggctagattcctggcattggccagtttccctgcttcttctaggaagcaaaatgtccctgggctggccgtgcagagatcacgcaaggtgggaaggggagatggagcatgagaaagggggcttgacccaggagtcactgtgtttgggccacccagggcagccacacagtcctgtatgaacccctggccacctgtttgaatgtcaggcaaggtcccttggcttccagaagctctccctagccaacgcagtcagtgcccacccatagccccttagtctactgcagaggccatctgtaggcgggtcccatccttgacctgaaggtgatcttagtcatggagcaggctgccaacccctgtgggttcatcttcatcctccaggagcaacccccagccaaagtggtagagtccgtgggaaggaccccagtcctgagacatgttccccacagtctcacagaggctcccctgtgggccacgggcctcagggctggattctgagctgggactggtacttgtacccaaacggccctgaatccctcattgaatctcactggagcttcaggaagttgaggaggttgccagcccctcctatcctaggtctctaatgcagaggggccctcaccttggggggcaggatgggccagaggcccacagcagtgacccactcatttacacaccttctactggctttcccaccttccctgccgcagtctccccactcccctcatgcccccaaataagctacctgcacccaaatccttgtctcagcatctgcttttggggaaacccaaacttgaggccccctcccctgaagcttggcactagtgctgtgtgggcaccaacttctggttgggagcaggtgttttctgaaggcaaaggaatggtttgcatggtccagggggctcttgtcctgttggctgcaacatactctagagacagtgccccttctctcaaaattgaggaaagcggtttagggacctgaactccagaaaccacaatgtctttctccctaggaggctgtcaccctcccaaagaaagcctttgggtccacagatgaaggtctttctgcattagatacctaggaggggagggactggtggtctccttaactttttgaagttcttgatcagagctaatgtgggattcagggtgctgtggctagaagcaccagtcttacttcagaatccagtgagctcaggaatcagaactctgggattttgtctttgaatgactgtcgggatagcgtcctaacaggtggaggcagagggtgggtacagagaatcgcaggcctgtgctgacaaggaatcggatttctgctgctgtcaaaaaggccttaaaatggtcaccaagcccacagccaaggaccagtttaggagatgagacaatacgctcgggccaagggactcaagctagctcaagatggcatctttggccactccgaagtgccaggctttgcactagactcatgccagactcatgaatgtctttgttgttcacggagatgcctcggtcagggcaaaggcaggatctgggcaggaatttaagtttcccaaaggtagccgccagacagaatctgcctgtccttggatcttctcatcttggaatctccaacaagacccctgtgagacctggagctggcagcagggctagcttcctagtcccagctctcctgacaagtccacaccatctcatggccacttcattcccacctaactatgcactttcaacattacagctgtaacccaatcctgcagcatcctatctcctggaggggaatgaaggtaactcacacttattaagtatctactgtttgcccagcacctagtattttacatatatgagctcactcaaccctcaaagcaattctatgaggagggtgttattattatccccgctttgaaaatgagaaaatggaggcacagactgtttcactgacttgtccagcatcacacagcttctccattgcagaggcaggatttgaactcagggggtctggattcacagtgggctcctaaccactattataaatgtccttgaagttgatagagaacaaagctccggaagaggatcttggaaaggggatctctccccacttctgcttggttctctctgcttagatcttggtgtttttggccaggtgcggtggctcacgcctgtaatcccagcactttgggaggccgagttgggtggatcacttgaggtcaggagttcgagaccagcctggccaacatggtaaaatcccatctctactgaaaatacaaaaattagtgagtgtggtggcaggcacctgtacttccagctgctagggaggccgaggcacaagaattgcttgaacccgggaggtagaggttgcagtgagccaagatcgtgccactgcactccagcctgggtgacggagtgagactgtctcaaaaacaaacaaacaaacaaacaaaaaagatcttggtgtttttcactgggtgggtatgatggttaattctatggtcaatttgactgccctacaaggtgcccagacgtttgtcaagcattattctggctgcctttgtgagggtgtttctggatgagattcccatttgaatttgtagacagagtaaagccgatagatggactccctgatgtgggtcggcctcgtccaatcagttaaaggcctgaatagaacaagaaggctgagtagagtgaattcctcctgcctgactgcttgggctcagaaatggatctgttccagcctagactcagcctaggtcctaagccggctggctttctgattagaacttgcaccactggctctcctggctctcaggcctttggtctcagactgtcactatgctattggctctcctgggtctccagtctgtagcttgctgactctagatcttgggaattctcaggctccataaccatgagagccagctcttcatgataaatttttacacacacacacacacacacatacacacacacacacacacatacacacacacgcatataaaattttacatgatgtaaaaatctcctgttggttctgtttctctggaggaccctgactcagtgaggctgtggacttccttcatgggcaccaaagttctccatttccttgggggcactgctgttgttccagccaatagtggggatgctgctggtggagacccgccttgaagagatgtagcaggaaagagcagtggaaggtccactgggtgtcatttagcaatcggcacaggcatgaacccatcggaactggctctggacataaatggcaggtgagaactgccttgcgtatgtcccaactccagtgacaatactagagcacaaagaagatggctattttgggccatccagaatccacctcccctctgtatgtttggaaaaagtccccgatatagaatctaagcatgccagtgacgcactctgccagcctgcattgcttgtgaccaggcttgacaaccggatgtgcccttcctggaccttttgtctggagctggccacacagatgcaggatacacagatgcaagatagacagatgcaggacgaatggagaacctgtggtcgtggttactaacagcctctatccagttcccaggggacagtggcctcgtagtggctgcagtggcatcctgtatccaggacccacaaaatggggcccctggtgctccatggaggtggtggagggtcctcaccagaccatgcctaggctgtgactttggctgtggtcctgtatacattgtcacaaagccaagctgatatggttaggctttgtgtccatactcaaatctcatcttgaattataattcccataatccccatgtgttaagggagagaccaggtataggtgattggatcatggggccagtttccgccatgctgttctcatgatagtgagttctcacgagatgtgctggttttacaagtgtttggtagttccgcctgtgttcattttccctcctgccgccttctgaaaaaggtgccatgcttccccttcaacttccgccatgactgtaaattttctgcgtctttcccagccatgctgaactgtgagtcaattaaatatttttcctttataaatctcaggtaagtctttttttttttttttttggacagagtcttgctctgttgcccaggctggcgtgcagtggcatgatcttggctcactgcaacctccgcctcccaggttcaaacaattctcctgcttcagcttcccgagtagctgggactacaggcacacaccaccgggcccggctaatttttgtatttttagtagagatggagatttcactatgttggccaggctggtctcaaactcctgacctcaagtgatccagcccacctcagcctcccaaagtgctgggattacaggtgtaagccacctcatccagcctcaggtatgtctttatggcagtgtgaaaacagactaagacacaagccctcccagaaattctgcaacctcctgataccctttcagcaaatttctctgctgcttcaattagccagaatcagtttctattgcttggatctagaaccctaattgcagcagccaactctgggctaggaactccacagtctactcacatcatctcctttagccctacccaggccttgaggaaggtggctttatctcagcaaaactgaggctcagagaggttgagtaatttttccccagatcacagagcttttggtggagctaggattcaaacccaagtcttactgacctcaaagacatggaatcctcagccactaagatccccaactccttttctgcccccactgctttaattataccaataagcaagggaaaagcagaaacaagcccaccacgcagggaccagcctgggagccaaattgcttctgagctgaatgtttctctcccagtcttcagtgaggtggtggcagctctttaactccagctgcggcgagaacacagtgctcatatatattcacaagcgggagatgaaaagctgcacaatgcccggccattaatcctaactcaggccttccaagcggcgtgtgatgatctgcctgaagcagcgccacattcgtgctcgggagctgggaatgcaccccaaatccaccgccaggggcacacagtccaggctcccccaccacactttaccgtccaccctcatgccctaatggcctcatcaatgtttcgtggccgcctcagtgctcctgacagataaattaatgagttggccctgagctataggaagcacaccccaagagaagacagaacttaaggaatttaagccccactgcgcctcttgtgcccaaggtgggagagttgaaagctggtttcctggcgagggtgagtggagatggtcatttttctggcattgattcgtgggttttcatttcccaggagcagcctggagcaaaggagaacgtgcaagatgaatctggaaggcctcccccaacacggcatgaagaggacccgagccagccagtctgtggatgggcaggagacacagggagccctgctcaggagcccgtgtgagcacagaaggggcagccaggctccaggtttgttagttgtccagacacctggagcctatgggaggcacagaagctgggaagctggaggtccgtgtctggctacacacggctgggactaaaggattgaggttagtgcttccaaacgcacttggtgttctaggcatgggcttccagacctggacctggctccctggcaaggcctcccctctgtccttctctccacccacctctgtcccctccctgctcagtgctcgacacccaccatgtcacccagccccttacttacttctgacctctgaccctcctcactgccattgactgcagctcattattgtccttccatcaggtgcctcctctctggacatgggaggccacacagttctgctctcgggactcagatgccacccagcaccccctgagcatgtcctgcagcctggcctccttcgctgcttcctggcagccaaccaatgcagagcgagctttggaacctggcctgggcatacatttggtctctactaccctgcagtggtgagccctgggcaggtcatttaaactctgagcctctgcttcgtgtgcagtgtagtgcagtgggtgggacccaccttgcagagttgtgatgaggttgaatgaaactgcattcaagggagagattatttccctccccactccatgtataactacaactgattcctaaagagtggactcattccctggaggcctctgtgttctgagtactttgatgagtctggagacacagaaatgtgcctggggttagtgtgagtgcctgagaacactgaatgaacttctttgcacaaaagaaggaaaatgaacaacagaggaaaattcacagctctgaggtcggaggggggaagggaacatgaagagatgggaggatgactaagaaaagaaggccgggcgcggtggctcacgcctgtaatcccagcactttgggaggccgaggcgggcggatcatgaggtcaggagatcgagaccatcctggctaacacggtgaaaccccatctctactaaaaatacaaaaagttagccgagcgtggtggtgggcacctgtagtcccagctactcgggaggctgaggcaggagaatggtgtgacccgggaggcagagcttgcagtgagccaagattgcgccactgcactccggcctgggcaacaaagtaaggctctatctcaaaacaaaaacaaaacaaaaaaaaaaaggtggggggccagcaagatgaggaagatggcggagaccatcctggggacaagtgaccattggaagtcgacactgttgtgccaccaaagaactcgatgtctaggaagttcacagagctgtgtgcagtttctctatccctctccaaaccccaaagctggaagaggagcaggagtgagtcttccctttttttgttgaaaaccaagaaaggacttgattgtctcaaggcccaagacagagacagcccacatgggatggggggtggatattcagtccagaaatgaaatcaaatccacagaagcagggttctggagctggaggggggcatgaggacatggcttgacctcctggggtatgaaaggggcataggaccctttctctagatttcaagggacagggaggctccatctgacatctggttatgtctaatccacctggcctctggtgggcttccagatgtggattcattcccacttccatcctgaaagtcagtgcaagggtcacaggcataggctggaatgcccttctagagagtcccactctacccttgaagcaggccaggaagggaaagggtggaggactgaccgtcaaggccacatcctcagaggaccagctgcctggggttcatgactcctcagtccccttccagccccccaggccagagccacatgcgagcaggcagcacaggactcagaggaaaacctgttaccgctcctactaacaggggatgacaatgccaacagcacagccacttccaaaataggaactgataaatcattaaacttgtcagattactcaagaaaggctgggccctggtcagcagggaggcaggctgccctgggcacctggtttaacctctccagtcagagggagaccagtggaaaggctgcagagacccccaccccaatccaccctctccaggacttgtgtgccacgtggctcatgaggccgcctcctccctttctttcctctgaggcttttctgcaaactcgtggactctggagtcagatgctcagatccaaatcccactgtatactctctgggttaccttgagcaggttgtttaacctctttatgcctcagttttctgaacggtaaaatgggaataataacaccatggactgcaaagtgtctggaataatgcccaggcatagacagccctgaaagcactgggggtcatgatttatccctactgaccccttgaggctgcccctgccacaaacaaggccaggctgctgctctcaggattgggagataatatttcattaatctttgtgccacctctgacttgctgacatgggcagggatgtcagcttcctcttcctgtatcttagcaacatcatgaccacagggaggaggtgggcataaagggcttccagttctttagcggaaaaaaaaggagaatcggtcagctttctgtgatacacctccagaaaggagtcattgcagtggaaaattcaggaggaagaaggaggggaacccagtgtctcatctcagcctctgagcaggccaaggacacttcattccaccctgcacatgagtgtatttttgtctgcctttcacagtctttgaggaacttcctcctgaatctatcagtgttctggttgcaagcaatggaaactgatgctgaaggaatgttttggaaggatatgggggcacacactgttgatgggaggaaagaaagaaggcttggaaagtagggagcaagagggttctggaagctggaaagcagaatctgtctgacacttctgcctccatggtctccacacacagccgctatgtcaagaggctactacaagcaaattctaactgtttctatgtcttttcactactcagccaaagtcaaagccagaatgtatgattggctaagcttgctcacctgactggactctggctgtcaggattggccacaatgggtcacctgacaggactctacctgtcaggattgaccataatgggtcacttgactgggtattggttgttgggactggccaaaccagttacctgactggactgtcaggactggcccgcagtgggtcacctgacattattggctgttgggattagccaaaccggttacctgactggactcagtcaggattggccacaacaggtcacctgacattattggttgttgggattggccaaaccagttacctgactggactctagctgtcaggattgaccataatgggtcacctgactggaccctggctgttgggattggccaatcctgtcacctcactcaactgtggctgtcaggattggtcacattggtcacattggtcacctgactgggtcctggctgttgggattggtcaagacaggtcacctgactgacccaggctatcagagtaatgagaagaaggtctctcccttgggctgagcagaaggttctggggaactgtgccttgccacactgcctacaatgggggcaaccccagatgtacaagtctgctgctgtccttgaagttttttcccttgcctcctccccagtttgcctgttggtcccactagggcagtgccatattggcaacttcccatgtcctccacttacagcagacaaattggaaacctcccttgtgggaggaaggatgggaggatgggctccattacaaagcaatattctgaaggagaagagagccatttggacgggaagatggagctggtaaatctggcttgtctccctgcatcgggggcaagatggattttattcataaatattctcagtgatcttgagcttcaagcagcctgcaaatagcttctaatgagaaccccttgaccttccctctacccaccaccaccatcgccctgcccagaccctgcccctttcttctctatcacttcatttgttacccaagtctcccatctttctacctctcattcagagtcacactgggggccctttccctgcagcctggatgacatccatgtgtcctcagcatcgcaccttcctggcccagccttgggcccctaacttgtttcccacaatctaaagctgagtctccccactgccacccagacctatcacagtctttctgtcctcattgactgatgagaataattggtacccatcctccaaggaccctctctgtgtggatctgtagacgacagatttcaaattgatttaaagcctgtgtcatgctggcttaaagaaaaatccctacagaaattagccagtttaacatttgggagatgcttagcaaaacctgcactgggtaattacaaaggaggcgccatttcccctcaaggatggagggaatgcagaggagggtagagcagtgtccctactccaaactgcccaaggacaccagggcattgctgccactgctctctgagtccatctcttctgagacgggatgaaactggcttaactgatgatttgctcatttgttcgctcacaccttcatccatcaagccagatgagtgccaagcgtgcatttcagtctagcccctcatcatctgttgcctgaatcactttaccagttgcctaaatgatcttcctgtgtccagtctcttcctcatccagcctgccccctgtggggccacaagggcaatcttcccccaacatgaagctaaataagtcactctcccaaagaaaccctgtaatgtccttcccattacctacaagctacaggtagtcactctgaagtaaggcacgaaaagctggtctcttcctggctgctgctgaggtctctggcccatctccccaactgcccagcacttcgatgccataactttgccacactgatgtttcgcaggccagcgcatgctgttcccgctccctggaactgctggcaagttgactttcctcccagcaccctgccaggcatccccacttccacagggcctccttcaggagggatcatccccatctcctgggtatgatttctgtaccttctgatacctttggtcctcacatatgtggtcactgttaacttacgtggtgatatggtttggctgtgtccccacccaaatctcatcttgaattgcaactcccataattcccatgtgttgtgggagggacccagtggagatcactgaatcatgggggcggtttcccctatactgttctcatggtagtaaataagtctcacaagatctgattgttttataacggttttcccctttttcttggctctcattctctcttgcctgccgccatgtgagacatgcctttcaccttctgccatgattgtgaggccttcccagccacatggaactgtgagtccattaaacctctctttctttataaatgacccagtctcaggtaagtctttatcaacagcatgaaaactaacacatggaaaacccttgacatatctgacggcaaatagaggcaaggcccagccccagcgcagtgcctagctcaaggccaataaccatgttgaaccccaagcagcacacttgggactgagaagctgaatagacacagccctgccctcagggagctcaccttctaatgggacactggcccttttgctgtgttgccttccaattaaccaagtggccatggtgagtgacatttttgtcagctgttgaccaacatttacctattcagtactagccaggtacagcgtctcatgcctgtgatcccaacactttgagaagccaagacaggaggatcattggaggccaggagtttgagaccaacttgggcaacatagtgagaccaggcatggtggtgcctgcctgtaatcctagctgcttgggaggctgagacaggaggatcacttgagcccaggaatttgatgctgcaagtgagctatgattgcaccactgcactccggcctgggcagcagaacaagaccctgtctctagaaaaaataaatatttatttactcagtacttattttgggtggggactttttaaggcattttagacccatcactttatttaatccagtggctctcagtgtcacctgggaagttgttagaaatgcacagttggtttttttttttgagacggagtttcgctcttgttgcctaggctggagtgcagtggcacgatcttgggtcaccgcaacctctgcctcccatgttccagcgattctcctgccttagcctcccgagttgctggggttacaggcatgcaccaccatgcctggctaattttgtatttttagtagagacggggtttctccatgttgttcaggctggtctcacctcaggtgatccgccctccttggcctctcaaagtgctgagactataggcgtgagtcgccccaaccagcctagaaatgcacagtcttaaggctctccccagagccactaaattagagaccagggggtgggcccagccagctgcattcaacaaggtgatactgatactcattcaagcataaaactaccctaggggaattgccccaatgtacaggggaggacactgaggttcagccaggttaagtaacccacccaggatcccacagtgaggccacgtcttggtcggagagtgtggtaggctgaaaaatagctccctctgcaaaagatagccacgtcaaatccctgggacttgtgaaagtgacttcgtttggaaaaagggtctttgtagacataaggaaggatcttgagatgggattatcccggattatctgagcggaccctgaatgccagcacgagtgtctttataagaaggcagaaggcgttcaacacccagagaagagaaggaggcactgtgactgcaggggcagatatgggagtggtgctgccacaagccaagggttactggtaggccccataagctggaaggggcagaggaagagtcttccctagagcctctggaaggcacgtggtcctgccaacacttggatttcgacttctggcctccagaactgtgagaaaatgaatttctgtggtttggagcctcccagtttctggtaatttgttacagcagcccccggaaactaatatagagagccacaaaaggctggtgctgctcttggaaatgtgatcagattcccatgccaagaggacaagatgcttggcgatagtcccgtgggaccagcctctctctctggcatcttttcagcctcgtgggagagagtcttcctgtttctgcgagagaggcagtcccctgaggacagggagtgggtcctgcttctcactttatccccaggcttgttaagtggttcatcgaatgaagattttcatctcgaggttcaaaccgcaagaggcggctgggatattggagctggctccttcgcagagctaaggttctcaggcaggaagttaatctccgtagaagttttctgaggccagagaagatggtgagtcattccctttgagagatttcttatacatgttcatctctgaagtagccaaatgaacagaagcatagacacgcttcttacactgtaatgtgcgtatgaagcaccaggggatcttgttaaaaggcagattctgattcttctgattcagcggaactaggcagggcctgagagcctgcatttctaacaggtcccccccgggcatgaccgggctgctggcccatggcctatcctcagagtcacaaggcactgactctggagacaattctaaaatcacctgctgcaacaccctcatgctaaagagaaggaaactgaggccaagaggagggaggtggctcccccaaggtcacagagccggaaatcaatatttgatgctaatctaagtggccgccctggcttgtagaggccggaaggggaatggaggatgttccctttggggcatgaggttcccctgacgaccctacctctgacaaccctacccggccagctctgttgctcaccctcctctacattttgaaacaaacgtcagctgccaggctgatcgataagcctgctcatctgtgaggcttgaggctctctccacagatgtaatcagggctccggagacgtcctggcagcgggcatgtggggagggagggcagcgatacatttaatcaaggaacagatggggagctgatagagtgtgtagaaaaatcaggtttctgtgataacattctcttcccccactcagcctccgcatcccttgacttctccaacaagaactcccagtgccaactccagccctgccctttccaaaggtgtttttcccaggaacctccgggcccttgaagatgcaggggtgggagtggggtgggggttgctgcctgcggagccctcctcccaccaaagcttcctctatttgctcctttctccgaccaaagcgggaggaggccaggaagccagggagctgatggccaagcactaaatagtccacccagaaggcttccgagatgctggcagccacagactcctggaagcttgcagggaggaaatggagatcatccgcctcttgaaccccttgcccactgccaagttcacaggtcttcagccctcatcgcctccacaggtgtctgagtccaaggagtggaagtatcgggattctatagcagtggttctccctgggggcgacttgacgcctaggggatgtttagcaatatctggagatctttcctgatggtcacgactggggttgggagatgctgctggtatttagtgagcagagcctgggatgttggtaaacaacctgtagtgcatgggacagccccacaacatgatttatccctccccaaatgtcagcaaagcccagcttgagaaaccccgctctatggaaagaaagccagatagtggcaggggctttactgagaccaggctaacctgttcctgggtggagtcatctggctttttccccatctatattcgatcctcaaactagcacattcacgacctacgcaggttctccatacataccccacccccccccaaatgatgtggcctcagaggggtcctgatagagttgagggttggctggggcaggagatttcctgctggggtctcacgtgctcacagcaatagtgccattcacccttcaggttcctgtgaagacaggctacaccgggtgtggaatttagtgggtaggtagtaaacaaacaaatgcatgaagtactcctcccctcccacccctgcaggtcccatctcttatttaatcccaggaaattcactgtataagcaggggtgtggggagggtggctggggcatcccaggcacctggcctagccctccctcctccctcagggccccctcgctgcccagtggcttcaatccggaccaggcttctttaggtgacaggtctgagaggtgtgaggctgtgtttgtgtcatctcccgccctgatgccaggctctgtccctcctgggcacactatgaggaggcctcatagtggagctaccctgagagcaggctccctgcctttggagtcaccactcagagcttggggtgacctgtggaggcagcagcctggagaacaggcgtttcccctcttgccctgatcttccgagttaagctttggcctggctgtgatgtattattagtaataatgcaagcccccttatttattactttttagcagagcccagagctcaacgtattgaactcacatcaccaaatcttctcggccatcgcatgacgatgtttaattcccatttgactaatggagaaaccgagttttagagaggttaagtaacttctgcaaggtcacagagctggtaaataagcaggacacccaggattcccaccctcgactgactccaaaggccatccttttagtagcaggggccccactgtccccctggtcgcccccctgagcggtccacacgccccaccaccagcattacctggaagcttgttagagtcacagaatcccagctccaccctagaatatgaaattggcatccgcactttcatataaagaccctggggactcagggtgcattacagtgacaattctccaggacaagtgctacgttcccggagggtggggggtgttggggtgaatggagggggatgagcatgtagaggctctaaggaacccagggaactgggggcaggtgcagagttcgtctgggccagtttggtccagcttaccagatgtttcacttgctgacctccagggccggatgacacctgtgtctagccacatcccggccttcactctggatattcgagaatgttgactccccacttgagaagttcccctacttccaactccctggaccccctcccctcctgctcgtggaggcagctggctgggtctgatctctaggcatttgtgttagccacattaccagaaggggccctgatccagacacccaagagagggttcttggatcctgcacaagaaaataatctggggcgagtccataaagtgaaagcaagttgattcagaaagtaaaggaaaaaagaatgcccttacccaaatgctgccagcaagggaacaccctctctggctgcagcccctctgaatggctcatgtcattgagccttactttctcattacaagtcccactggcagcatgaatggggggtctggagtcccctatatgtgactgtcagaggtgtttgaacaagagcaactccatcttgaatgggggctggataaaatgaggctgagacctactggcgccagttatggttaaggcattgtaagtcacaggatgagacaggaggtcagcacaagatacaggttataaagaccttgctgataaaacaggttgcagtaaagaagctggctaaaagccaccaaaaccaagatggcaatgagagtgacctctggtcatcctcattgttcattatatgctaattataatgcattggcatgataaaagacactcccaccagcaccaagacagtttacagatgccatggcaacatcaggaagttaccctatatggtctagaaaggggaggaaccctcaggtcaggggattgcccacccctttcctggaaaactgatgaataatccaccccttgtttagcatataatcaagaaataaccataaaaatgggcaaccagcggcactcagggctgctctgcctatggagtagccattctgatctctaggcccagacaagcccactctcccctctgccagaacaaacttcccctggtccccacttcctgagcattttcccaactgcctcctgcatttttcttctgcatcagtctctctcattggaaacactttcatctcccctttgagctggatttggggcttcccctgagcctctgaggtattgtctctgtcaccaattagaatataaaagctcagccatttatcaaagatacccagaaagcagtacctggactgaagtgcagacaggcatgtgtctgcaaacccagatgcagcctcgcctggcgtgcaccgtttccacccaacgtggtcaggaggctgggaatgcatttacagacggtccctgtaatcccacaggtgggtgaggggatttccattttacatctgaggctcagggaggcaagggactcccttaagtcctatgagtgtgtgtataagtacagccaaaaaaaaacgggccgggcacggtggctcacgcctgtaatcccagcactttgggaggccaaggcgggtggatcatgaggtcaggagatcgagaccatcctggctaacatggtgaaaccccgtctctactaaaaaatagaacaaaaattagccaggcatggtggtgggtgcctgtagtcccagctgctcaggaggctgaggcagaagttgcagtgagccaagatcacgccactgcactccagcctgggcggcagagtgagactccatctcaaaaaaaaaaaaaaaaaaaagaggcaacgactcaattaaacaagttactctcttgccaattctgatccgcttcctccttcaccccacaccacacccaatgtgcccaagaccagctgagaactcaaacattcctctgggtgtgtcaggatcaatgaacacagaaagtccaggaacacattctaatgaaacacggtggctcacagtgttcctacgtaagctttaggcttatttgcacatttttagacagtaaataggctcaactctgagacaatgaaatgcatcatttgccaggaggcgactccatgtgatggaaactgctagaacttggctggacccggttgccactttcccccttggtgactcgaggctgggatcttcaaatattttttaaagttgtcctatttaaaaaggaattgatttattctgaattgttcaaaggttgtgttaggaccagaaggcagaagaacagggagaaacttggctttctaacccttactaacagtaatggcacacaattactggcctcggagagcaatgtctcagacacgcagggccctcttcctcctacccctaagattccaccttggtctacaggtgagagccttccaggacctcctgtgtgacccagagtgtgtggggagagtcctcactccctcctaaacgaagagaatcagggcctagttgggagatacctgatctcaactgggccacatcccagcctgataaacagattcatggctgggtcaggctagcctggaggccaccacccaccgctctctactcctggtgccagctctccgttccatgcatgacggggtctgcaaggcaggcagtaaccctttggggaaccaatgggtgaggtggtgagtccagagcctgcctggtgggcccaggtctcctccgggcagactctaatgtctcagtttgagagagaagtaggtagaagactctgactttggccctatgagcattttccactcaagcgttttcaggagaccctgcccattaaagcaggggtctgcaaatgttttcataaaggtctagatagtaaatactttgggctttttgccccaaacagtctctgttgcaaccactcgatgccattgtcatgcaaaagcagccacaaacaatatgtaaatgaatgagagtggctgtgttctaataaagctttatttataaaagcaggccacagcagggctggatttgacctgtgggccagagtttgccaatctgcttgagagttactgggcctccaagactctgacacgcatttggctccatgagttcagagggcaaggtgggtgaaagatcgatgctcccatttgtcaattggaaccttgggggtcacccattaacctggtagatcttccaaaagcaccctggggtccatgctgtcatcatccccattttacagatgagaaagtagagactcaggctcaggaccttgccctggattcatattggtggtgacatttgtgttagccacattaccagaaggggccctgatccagacccccaagagggggttcttggatcctgcacaaccagataatttggggcgagtccataaagtgaaagcaagttgattcagaaagtaaaggaataaagaatggctactccataggcagagcagccctgagtgccgctggttgcccatttttatggttatttcttgattatatgctaaacaaggggtggattattcatcagttttcggggaaaggggtgggcaatcccctgacctgagggttcctcccctttctagaccatatagggtaacttcctgatgttgccatggcatccgtaaactgtcaaggtgctggtgggagtgtcttttagcatgctaatgcattataattagcatataatgaacaatgaggatgaccagaggtcactctcattgccatcttggttttggtgggttctagccagcttctttactgcaacctgttttatcagcaaggtctttataacctgtatcttgtgctgacctcctgtctcatcctgtgacttagaatgccttaaccctgactggggaatgcagccccagtaggtctcagcctcattttatccagcccccattcaagatggagttgctcttgttcaaacacctctgacagccacatagaggggactccagaccccccattcatgctgccagtgggacttgtaatgagaaagtaaggctcaatgacatgagccattcagagggtctgcagccagagagggtgtccccttgctggcagcatttgggtgagggctgcctagctgggcgtgggggcctgattccctccgaggcttcctccagctctctgcaggtgacaccaggctctttataaatagcagggcctgctttcaccaggacttgctggtctgctgctttgtaaacaggctttcttctatttgtgctctcttctgagcatcgttctatactccttgaggttagggacaccttgatagtgaccacaccctgccccacacagcctggacagatctctgttcactgggggcctggctgaccagtgatggaaggtgagtacgggagcaccgtcacccagagttcactaaaccttgggagtggacgacctgagagcccaaggtggccttggtctctgcccatcatgcctgatagagagcacctacctccaggaatggaagcagtgagggaggctttgtgtttttcaaaagaataaagtgcaaattggtggtctgactccaatgccaaacaccgtgcccaacaggagatccctgcgcagcctgccagcgctgacaaggaggaaacagtaacaaatgccatctccacgaaaatcacatcgcagcattcgcaggcaagagtgggggcctgggccacacactggctgctgtgtttccctgcaagtttccaagtcactgaccactagggatccctgccactttacagatgtggaaactgatgctctatcaatgtcatcagtgcgaacatctacccagcgcttggatctccttagcaggattgcaaacctagagttagttctagaatcacttgaggggccggggttctgttttattttattatattttatattttgatttttatagacaaggggtctcaccttgtttcccaggctggtattgaactctgggtctcaaacaatcattctaccttagcctctcaaagttctgggcttacaggcgtgagccagggttctgtctgacttattcacggctctctccagagggcattgcccagcactgacacacagtaggtgctcaaaaaacatgcatctcaggaataggtggcaactggggactgagaggggagagttggctgaatcccacagcccagcactcggcccctcttccctcctgcacccccagccaggtacagagttacatctgctcagcatccagacaccagagatgctctggcgagatggacgcgtgctttgtgaattagcgatctgcctcctacaagacaataaaaaggactaattaatttaaagccaacataaggcagcagcgaggtgagcattacttgtgtacaagcctgtatgggtccagcattttccgatgaaaacaagatccacccagcgggagcttctgctgggccagaccaactccaggtagctccctgctgggcagtggctggtgccaaaacagggcacacggctggagcaggtctccctgtatggggttatctgccagagcacagagctgcagaaccggccagcagcaggccaaggcctcggtgacaagctgcccccagcagctcctgcctccagcctccaggcccggcggagtcagctgccgcacctggtacttcatttacagatggaagctggcatctctcagaggtcttcagcctctggaaacaggcccaggggactgaccgaccctcagcatttgatgttggcaacatcttggcttccactaaaacctcgagtctgcagagggaaacggacttcgcatggggctggggtcaagtcttgacttagccacaccttcccagctgcccctgggcaagttattcagcctccaagtcacagtgtcctcctctacaaaagagacgatatatgtaaagctctaagaaaactgccaggccaatagcaattaagcaaggaagccggcctgctgatattctcagggatgaattctccagtctcaacaccatcggccagggaagagaaatggctattataaagcaagaagaaaccccagtttctgttcagcctggcagaggggccaggtcctgtctcctttctttgcacctctgactccactgatccctccagcctggcaccagctaaaggctcaggagaaaattcaatctgctcagagaaatttctgcaccactacttgcttttcttttcaagggcatcgttccaggtggattggatccaggacatctccccctgcctatgtagagagtggcctgacctgaggtcacagccctcctgggcagccctgcatctcatgactgagccaggtcatggggggctaaaggcttggctgtttgggcccaacttctacctctgtctaatcctgtatcctccccctccctatacaaagttgatcccccataaatatcatgcacctgccctctgggagtttctttctttcctttcttgaaatggagtcttgctgtgtcacccaggctggagtgcagtggcatgatctctgcttacagcaacctccgtctctcaggttcaagcaattctcctgcctcagcctcccgggtagctgggattacaggtgcccaccatcacacccagctaatttttgtatttttagtagagacagggtttcaccatgttagctaggctggtgtcaaactcctgacctcaggtgatctgcccaccttggcctcccaaagtgctgggattacaggtatgagccactgtgcctggcctgtttctatctgcagaacccaaccaaggacagccacctcctcccagcacaggcgcccactgcgctgctctcccagccccaccctctgtgggaacgccccacgcaggaccctctcatcttcactctttctacccctgacacccctcagctcagctcaaatcttacctgaaggcatctctctcttcttctcccttttcccttccaaacatcttaatttcctgctgctggctgtatgaggaattgtttaccaccataaaccacaatacaattccataaatacgttatttatccctcctgttattattccccattatttatttctgaaactctattattaaatctgtaaagtgttcggtgatacactggcaatgaaagacactatataaaggcgagtttattattatttttactccgtgattaaaacaaggaagaaaaatgaaccatattaaatcaaactggatttccttttgcccgcaggggcccctgctttgaggtgaaggacggacccccagggcctgggctgggtgaacgctctctcctccacactggctgctctcccagcttctttctcggctgctgttggtgacactagggagaactgcagatttgaaggaggctccatcgccgggcggagtttgttccgggcaaagcaaaaacgattccgtttgcaatcttactttttgccatcagtcactgccagtgacatgaaaaggtaatagaagtacccaggaatcctgcattttatttccactcagcagcatttctcttgcaggggaaacataaattcagccgatttttgtgcagattttgcaaaattagtctctttccatctagctctgtgtatatatatatacacactccatgcaggggcggaggggtggttctgccctgtgataagagagaatctcacatagaaaaactcatccagggagagatggaaggagggcaggaacaggaggcccagaggagagacgccgggtcagcgcacaggtgggaggattaggggcaagggcggggaggctctctgcatcacctggcaaagccctggcctttagtgcaatggttccctggaccagccagcatcagcgtcacccgggaagctattagaaatgcagattctcaggtcccacttcaggcctgctgaatcggaaattctagaggtacaacctagcgatctgtgttaacaagctcgagaggtgattctgatgccagagttggagaattgctgcttaactaccttgcaactcaaagggagaggaggcagcatcacccgggagcttcttagaagcgcagaatcttcagctttctcaagacctgctgaatctgaatcagcagttccacgagggtcccaggtgcttccctcacccattaacgtttaaggagcatggctttggtgttttgggcgctgggttcaggcctggcagggcaggggttaggaaagagcttttgagggtgggagctatggactggagctctggggtgacagagcaatgagtgggacatttagggataaaggagctggggccgttggagctgagtacccagaggcaaatgagaaaggcccaaacaatcgaatccaactccaacttttcgcatgtcagagttaaaggcaaaaatcatctcaatgggctgaacctgagacgtctgagtccttaggagccaaactgacatcctgtcattgttgttaaatctttatgacatgctcaccaaagaggaagcacagttgagcacgcgatggaatgatcgtgtgacggccttcagatacttttatgtactgtggggtgtcacaaaaccaagcgtactcgctgccaagttgggatttgttgctatggaaaccgttggactgagcatggagagactgaagtttcggacctcaatccccacgctggcccactgtgttgctcgagccaagtcaccccacatttccatagccggctcccactttttaaatgtctgttctgtcccaggcacagtcatttttttgtggcaagaatattgaagatctactctctcagcaattttcaacaactttcaagtatggcacacactcttactaactctagccaccatgctgcatgctaggtccccagaactcattcatcctaatgaaaatcttgaactcccccggcccctggcaatcaccatgctactgtccacctctacaaggaggcctgggacgttttacaactcattgttatctctgacaatgcatttcatcgtcattaacaatgcatcgcttaatcattactctattctgcctcagtttgcccagaaagaataatgtcccccttggttttccttcccatgtgatccacagtttgttttttatttttttattatttctttctttatttttagatggagtcttgctctatcgcccagcctggaggacagtggtgtgatagctcactgcaacctctgcctctcaggttcaagcaattctcctgcctcagcctcctgagtagcggggattatagatgcgcaccaccacgcccagctattttttgtatttttagtagagacggggtttcaccacgttgaccaggctggtctcaaactcttgacctcaggcgatccacccgcctcagcctcccaaagtgctgggataacaggcataagccatcgtgcccggcctcgtttgtttatcttaaaagaagagctgatctttgcacctatacccttgctcataaactccaaacgcttagcagttcaggccagcatggattcagcgctctacagatgcgatctttcgtcactcagaacagccctctaccttctgcccggctcgctcccctctactggtggccacccacatgtggcgtgttcacttgccccttccacagaaccatgtccaccttggagtgtggtcagcctgaaaccatgagggccatgctcaggggaggtcaccactgagcagttcaggggaggctctggactttgggacccctcgagcagcttcctaggaggacgctgagtggatcctcattctcactgtgagctggagtcaaagcagaccaggaaagagtggatctgagcagaccacctctacaagcctgatcagagcacagatggacacttcttggaaagacccacaactccccagtgagtggcagccacttctgcaccctccaccccgaggaaggaaaagagcagctgctgttcctggggaccagcctcgggccagaacctgcacagtgctttagaggtgtcccccaccccactgagtcctgagtgtacacccctccctgaagcctctccttgcctatcctggtctctgctggagtcgcaggatctaatggatggaaggcctcttacagaccacatggtctcatttcacaaaggagcagcttgacttgctggtgctcagagctggctcacaccacacctgggattaaaactcaggccgtgggacttgctgttgaggaattgtgtccaaaccaaccacagggagaggaaggagtcaaatgcccccagggaggccctgctgaggcaccagccacctggagaactagcacttgatggggagaggcaagcatgcctttgtgcactcattgatttgtttattcatccacctgtttgctcgcttgttcatttattcaacagctatttgtgtcctgccatgtgccaaacaccactaggcatggaagatatagtttggaccctagaagggttaacaggtgaaatggtctgccctatgctcagcctgattgactgcaagcaaagcctgaggaagtcaggattgcctggggaaagacccgataggcccccaaatgtttgctgaatgaatgcatggcaaaagagaagctgctgcaagcatagggacctgtaaattctgggagggggcttgcttgatgggtaaataggtgccctgaggtttgtgccctaaatgaccagcagtgtggtcgatctctttagacgtctaccctttttgaaaatggactttaattttcaagtatttgggcctcttgacacctgagtcctttcccatgaactcatccccctggggagcctggctggatctgtcacccatctcatgctgcaattcccctgcacaactctggattcatgcaggaggtcatttatttcttccctggaaacatctgtcatcagcgttagtgatgagttatgaggctggagagccctcagtttctctcaggacgtatttcaacctggacagctcctgaacagttctccctgcagctgctatgatatttctcagccccaatttgccctcttggctctgccaggaggtacagggtgctgggaatgaaaccctaggaaagagagttcttccttgagtccagtccaacgagcctgtctttgcacaggcacctgagaaacaaagtggtcagccttgtaattaatgtttctggcctctgacgaaccctttcctcttggaactggggccttgctggtaaccagagaggtactgggcctacccttctctgctgctctgggagggaactgtctctcccacctgggcctctttgggtaagaagcaagggaaaaggcaaatctcaaccctgaagactttatggaggaagttgcctttgcctctgagtctgctgtcttccatccacctctaagccattgctgtctcctttgtccctacctacttcttctccaccctcttcacacaccgtcacttattaactccaacctgcaaaaatagccaaatgatttccaagccctgaaagaggcagatagataatgacagagcgagttggtacggcggtaacaaattgtccgtattatagcactttacatcttgatatccattctcctcaacgggcttatctgtaaactgactgaattcacactgggatgctaagaaaatagctgtcatataatagatggggtctcccagaaaatgaacatttacaaatggctgtagcatttacttaaaatgtcatgccaattgcttgctgttgtctttatgcaatgagattgattttactgctccttggagtcctcagccttgatgggtagtttttaatgcagcagtgagatgcttttgcatttaatttataaatacagcatgccaagccatgcgctctttaaggtgcagccttgagaactgtccaaccctcttttgctgggatcctcctctcctctcctctcttctctcctcctcttcctccctagaggataagttggacctgggcagggtctgagttgatcctattcatgtattcaaatgtatgcagatgtatgcattttgtttaacaagttaattcatttgccaggccaggcagttgggggttttcacagtgtaatacccacactccattctcccttccacaccagattatgccctggagttttacttgcagaatttctggagttggagcctaatataggctggggggaggggctgcttgcctgttggagaagatggctgcagggtctccccaggataagaccaagggctctgtccagcctcccggttattctagaagccctgggaagtccagtgcacctggagaagtgtgcctccttgagaccacaaaacatgaccactcgtttctcccttatctgctgaaaagctacttacaactatcctttgactggcagccccagatggggaaacagaactccctgccacccccagacccaatgccctgtgttccctgtggtgttttgcatcctcttccttgaggaggtaaaatgaaagagctgagggaggaagggacggatgagctgccaaggctagatggaatggcccgttgcttctccctcctgtctgccctgggaagatttcccacagcatctaggagccttgatagagccctttccatctctagaagcctggctgtgcctatgagggaatggcattttcattcaaggcattctcggtgtgcagatctggataggagctggaattcctttggatgcgggtgtgtccttcagccgaggagcagctgatgataagcatcggctgcttatcatcattattgatactaatgatgcctcacctgggtcccactctgcaggacggctcgcacatccattatgccaccagatcctaggaagcagaggcattggcattctctctatcaatcatttgttcagcaactatttattgagcatctactacaagcctgaggctgtgtgaggacctgggaacagatcagggggcacaacagatttggtggctgctattgaaagcagctctattctggcagggaatggagacacatccattggtgcagcgtccctgctgcacctgagcctgcagcagcaaggaagggttgagggcgggcttcctggaggaagtgctatggaagccaaggcttgagggatgcatagaagccgacaggctgggattgagggaggagtgaggtacaaaggcagagtgttttcaggcagaggggacaatattttccaagaaactgaagctcagagaagatgagacattctaagtcacatgactaggaaatgagtgggagaccagtttctatgcccttggggtcccctggtgggaaacttcacaggtgaggaaactgaggcaatggtcaacacaagtctcctgattttgggaatcacccctccccttaggaggataaaccaatgagccagcccctttcatggaaaatgatcacctctcagatagattacagacagctgtggttatcaatgctggtctaaaaaagtgattagacagaatctaaataatgatttagattaatcatgtgcaaatgaccctctgtggggacaagaaaataataaagaaagccaacgtgttcagagcgttattacttacaaccaaggcctagcacattgttaatgttcaataaattgctgaaggaaggagagaccccccccccccaccaacttcctccatggagtctcaggcctctccctcctctttgcactgggtagtgaaacccccaagatcagatgcagagcccccatgcaaagccaggtcaaggtgtcaagtgataggggccgagctcagtggctcacgcctgtaatcccaggctgaggcagacagatcacttgaacccagaagttcaagaccaactagggcaacatagtgagatctcatttctacaaaaaatataaaaattagccgggtgtggtggcgcatgcctgtagtcccagctactcgagaggctgagaagtgagagaatggcttgagcccaggagatcaaggcatcagtgagctgcgatcacaccactgcactccagcctaagtgacagagtgaggccctgtctcaaaaaaaaaaaaaaaaaaaaagaaaaagaaaaagaaaaagaaataagaaaagaaaagaaaagaaaagaaaagaaaagaaaagaaaagaaaagaaaagaaaagaaaccactgatagaagcctggagctgagaggggcctaagttcaccttatccaacctgctccttatgtagagggggaaattgaaagctgcagacagatgaggctgtgtctaaagtcctgagagaactggtgtcagagtaagaactagaaggaagagctttagattcttctgcactggccaggccttgaaaatgcaagtattctcttctaaggaaagcagccccaggcgcttccttgaaaagtctgctcccacctcttgtgccaggggacctggttaccttggcaaccacgctgggccagggagactgcactccagccaaaagcagttatgggtaagccagacacaagggaggccagccagggtgttccatgtggatactgactgtatcagttgtctattactgggtaacaagtcatcccaaaacttagcggattaacacaataatcactttattatctctcatgatttctgtgggtcaggaatttgaacaggcaacagtgggaacttatctctattctctgatgtctgggaccttggctgggaagtcaagaagctaggaacaactcaacagtttgaggctgaaatcatctggaggcatcttcactcacaagtcaggttgttgatgcctgttactggctgggaactcagctggacttccaaccagaacacctccatggtatctaagtgggctagtttgggcttcccaccatcatggctgctgggttccaagaatgagagtctccaggagagctaggcgggattgcatggcctttttataatctcgccttagaagtcacttcatgtcacctctatatattctattggtcaaggcaatcacagaggtccttccaggactgagggagaataatgtcaaggtcagatggacattgatatggtttggctgtgtccccacccaaatctcttcttgaattgtagctcccataatccccacgtgtcatgagaaggaccccaccacacatggtcattgaatcgtggggcgggtttttcctgtgcttttcttgtgacagtaagtctcacaggagctgatggttttataaagggcagttcccctgcacatgctctcttgtctgccgccatgtaagacgtgactttcctcctccttcgccctccgctgttattgtgaggcctcccccgccatgtggaactgtaagtccattaaacctctttttctttataaatgacccagtctcgtgtgtgtttttattagcagcgtgagaatggcctaatacagatctggaagaggagatattactggggccatctttgccccagtaatctgcgcctaagcagggcctcagcaatctactcaaattcagttattttaagaagtatattattgagtgcctgttatgtgccagacagtgcactaggggatctcctgtgtcttggggagtttgaagaaaagtacacagcagctgctgagtcacactagggagaagcagacagaaacaagttcatgcgtggctggggagtccctgcctgcaggcctttccctcagaagcagccgcctttgtacagacacaggtgtccatctccaccctggcccccagcaaggtcagtgcgtgggccatatcagtgtgggtgtgacaacctggggtctggctgaccctgaggtcttgctatatcatatgtgcagcatcccctgcccttgagttcacaggagggcaagggagaaattctgtgtttatagcctgccatggagcagagtcgtggttccccattttcccctcctgctgagcatgacccaaagcctgccatcatcttccctttccacatccccacctgggctcctgcctccaaggcacagaagccttctcagggtcctttccggccccagcctccccagcctcctttcaaccaactgaatctcatagaagcagctggttttgctttttccctctgtcccaaagattttcaatctgcattgccatttttattttcaatgcacccccattaactcataagggttctcagaggccacctgattcttgcatacacccagccatgggcagctcaatccaactcatgtcgtttgcagacagctgaaccccttaggaggttctgcaatctcattcaaacaacactaaactcatctctagatcccactgtgcctctctcgccccactgaaataattgtggattaaaggaatctccccaggcaggactggcatttgtgcttatatataaatagggaaccttctgaaaagttaattgtggtggtggattatggtggtgacttcccagagagagacagggattgctttaatgaaatgaatgtgtgcagtgcaagggttgagtctaagctgaggggtttggcaaggggcagggaggaagggtggtctgatccaggaggaactgtttaggaaatgatgatttcagagaggaaggaggtcagcggaagctggataatttgtggcagagcagatctgatgaggagaaaggccagaaggaagggcaagagaaagtaaagatgaagccgttagcattcctaggggcggatgaaggccagagggctccggagggttaatgggaaaggtggctgctgggcagctgcttcaggcagacgccaaactggagagatctgggctcaaagcagaagaggacctgcttctccagcagacttgggggcaaacaggtacaactctgagttggactggagggtaggaagtaagggtggagcagcaacaaaagctgtaacattcattcattcattcattcattcattcattcattcattcgttttttcaacaatcacttactgggtttctactgtgtgcaaagcactgaattacgcaactccctagcagagggaattcccagggtgagctgaggaagtgaccttgtgtgcaatcaaaggtcatcctcagcagagtggactaaggggtccagggagcccccaagaatgccacagagggaggatctcattttgaggtgtttgggagccaaggaggataggtggctcttatagggggcaggaccctttctgtctcacctacagcttagaaaagctgcatccctgcttccctctcctgtggctccccagtgccatccgcatcctgtgcccctcctcactctgggtttccaagtcctctgtgcacgcctcccttcatctgatggtcatctcgttggtcttctgtcccctctgtcatcgtagcctgtcttgacccaccctcctaaaccccaaacctcgggctagacctgcctctctatccattcaaggaagttaccccaaggactttccaacctgtgcctcacccacaaacggtggtgcagcttgggagtggccattcccctcctcttagaactccatgactcagtggctgtcaactggggcaatactgcccatctactggacatttggaaatggggcaggggcagttgtcgcaatggccagggggtgctgctggcatttggagcatggacgccaagcgtaaccagccccgtgcagtgccctgcacagacccacatggtgaccagtcgccaccccccaatccccgagttgccctgctgagaaatatgaagcaggggccttcccagcaccccctcctacccccactctctccaggctatcagggagcgtgacctaatcacgcatgcctggctcagcccctctggcctcttgcactccttctgagctgcggaaagatttccatccttgtagatatcttgccctgccaggtgctggctgccattctggggagtattttcaattcagcagggaggacacagcagccccctgtggccccacagctgtgccaatacagcttttatggtaataaggctgcaatctttgaactcctggttccaaaggagtttgacgccagagtccctctctcatctggctccaaactcagagaaaggaccaccgttgtgactgaccaccagtgctcaaagcctaacagaccctgctggggaggttaggagggtctgggcccggagcctgcaaatccaaccagcaaaacccatccagggcatttccaggaaatgggcattcccgcccgtctccaacatgagcactggaaacgcttttgtgtatcttcattataaccttctctgccctgctgcttcccttgtgcattggagatcaggtttctgtagacacccagggcatcatgggtgcagccatgaagccccagcacctgaactggaaaaagattccttttcctttggtctaaggacaatgggggaagggagggctaaaaacaggcctttgatacacctgatcgatgtgagaaaattgttctttcattttaaaattgctcttggccatgaggacatctgcaccccatgcaccttttacagttgttctgtgtttggctccaaaccactagaagacagatttattggcagttcccagatgtccaggccagaactgcctcttctgaccttggtcaaggtcaagggaagaactagcctgccttcctctcccttgcagctctttctgcttcttcctgggcaacagcaaggggctgtggtgtttgaaaactcacctgagaagaggtgacacctgccatggagctgctggtggagagggaggcctcactgctccagagagagtgagaaaccagccacattcaactgctcagccctggtgagcttgcctgagattggagtccccgtctgtggctgtttgaaagagggcctcacttcataaagaaggcaagcaatccttcctcacctcccatccacagaggaatcctggctacagctggagcaaggctgggtcagcttccagaccctccagctccaactccagctctggaagctgacccagccttgctccaaatgtagcttccaatacacgagtgtccaccatgcatcccaagcaggatctgtgccatcttctggccatcacacccaccctgactctcactctccctgtgtgcctcactccagcccggcccattgtccccgagtagatgctatccccagacaggaaggaagcccctcaagatgccaggtgagttcgggttcagaccccaggctgagctgcccgggctatgttggggaaacccttggggcactgaccaggagccaattaacccccacaagccactcccagggctccaggtggaagaacagacttatctccctggtcatcctttgtctccatgctccaaatgccagcagcaccccctctgcactgcgacaacttacccctgccccatttccaaatgcctggcacatgggcaacattgccccaattcctcccaatgccttgctctcagtagatcccctgcccctgtgccccaggggaggagagggacggccgggggtgaagggcagagggagagaccgacctccagagcaactcctgagtccacaggaacaatccacccatctcggtggctggagccgcccccgtgcccagcaggccctgtcctggctcagcaccgcaggggggctgctccaggagcctctcctctctcagccagggaggcccacagcctagtgccgcctgggtcttcagggggtgtgtagacaccagaacactcaggctaccctggaggtattctgaacacctgggccagccctggatttttcttttcttttcgtttttttaaccactgatggcatcctgtcctcccacagctctgtggaacaggcagggccagtgtcacaatcccattttgcaaatggaaaaacctggaggcggcccctttaccatttccctttataaggcccaccagagctggcacagatgtgagctccttttccatgtggtccctcctgaagctgtgttcttctgcctctggctgcctccctttgctgttgtggctggggttgggaggtggttgtggtgctgctgctcccagagagctccgggactctagtctcctcatctctcttcccactggctccaatccccaccatctactccagcaccagaaagacctggaccaaaggaggtgggtaaatacagaggaagcaaggcacagaagccgctaaggtgtgaaaaccttcaggatcctgatgatattcaaacccggaaaggtctccaaggaggaagtgcaagccgtatgctctctgaaccattccccatctttgcatgtggcatttggcaaaaatcaggtcggactggacatccccgagatggagaaaaagaggtggaggattgggttcactgggtctttggcaaaatcagagagccaggacagcctgtctccaggtcacagagaggaggcacccaggccccatgacagagggtgggaactgagggtcacagaatgccctttcctgaagagtcggcaggggcctcaggccagtctttgggggctgcaagactctgagtctcaaggtacccggcggagcccaccacacatgacctgcacgagggactcgggagtccaggccatcggccaggatccccggcgccctgcggtctgtccagcccctggttggaagtagagacgacgtcaccttgggcatcagggaggagaatgatgcacgagccagcacaataagtggagacagatctagtttgagagtctccgaagatgatattactcagcagcctcacgcttttcatctggaacttattggaaaacctcgctaaggggatcagctgcctcccaggttccgactcccagctcccatccaattggcattaaggccctttaaagtattacttctcgacaccatgagcattgtatgttcctgacaggataagcctgccacaaattaatacctggggcagatcctaaaacacaattcttcccggctgcaataattccagccaacccctctatctgcgctgacagatgcagtaaatctttcatcgttgcaattcatattgtttttttcctctggtacctgaaatagccaagacaataaactttacctccttttatgattatcgatgtgcttatagggcacccatgctgcctgcaccagcaccgacccacccggggtcccattgagcctgtagggaagcggctccctttatcctgcaggctcacaagccccatgtggaggctggaagagttggtgggctggtgtctgggagagacagaggtgagaggctcctgtctctgagaagctgagggtggcagtcaaggaggagggaggggacctcagccctgaggttgcagggagagaccagggccagtgaggacagcggggagagcctcaggacacagaggtcctctgcctgcccttgtgccggccaaggtacatgagtgacaaactctgccaaggtcctctgtgcaggggactctgagaattgccatgcgacctgcctcattccacgttctccttattgacaagcacatcacagagagccagatctaggtcctagccccacaggccttgatttctccatctgcaaaatgggatttgtgacaggagccctgcctgttccacagagctgcgggaggacaggatgcaggctgtacatggcaagaagccaaaacatgacgtccagggctgggcccaggtgcccagaatgcctccagggtagcctggactaagcaagtctgcacattagcaggtcagccctgcagggcctgggggcgtggaggctgcctccaactcctagggctgccacaacaaattctcccaaagcaggaggctgaaaacaacagaaatgtgttttctcccagttcaggaggccagaagtccgaaatcaaagtgtcagcaggattggttccctctggaggctccaaaggagaatccgttccatacctctctcctagtgtgtctctcctagtgcgtctctcctagcttttggaggttgccggcaatccttgttatttcccggcttgcagatgcatcactcccatctctgcctccgtcatcgcatgaccttctctctgtgcgtggccctgtgtgtctcttttttccttttctgagacagggtctggctctgtggtccaggttggagtgcagtggcatgatcatagctcactacagcctccacctcctgggcttaagtgatcctcgcacctcagcctacttagtagctgggactacaggtgtgcaccactacgtctggctaaattttaattgttttgtaaaaacagggtcttgatatgttgcccaggctgttcttaaactcctgggctcaagtgattctcctgcttcggcctgccaaagtgctgggattacacctgtgagccactatgcccggcctcttctccttgtcttataaggacactggtcattggatttagggctcactctaaccctgtttggcctcatcctaactaatcatatctgtggagctcttatttctaaactaaggtcatattctgaggttctggatggtcatgaacttagggggacaccattcaatctgctacaggagttgggggtggtgactctgcctgaggggctcctaacagggcccacccccagtcatcttcaggtcccctgcagtcagcactccctccaaggacacttctctatctgtcccaccccaagaactgctcagaggcaaggccatcacctcgcccaactactccctgaagacttggggttccctacggagtccaaggaagcacagcttagccctgaaaacatgccagctgctcatttggctgagatgcagctgatccctatccacaccttggtcacctgttcttaacaaactagcacctgctacctgtaatcccagcaatttggaggctgaggcgggaggatcacttgaggttaggagttagagaccagcctggccaacatggtgaaacgccatctctactaagaatacaaaaattagacgggtgtaggggtgtgcccctgtagtcccagccactcaggaggctgaggcatgagaatcgcttgaacccgggaagcagatgttgcagtgagccgagatcatgccactgcactccagcctgggcaacagagcaagactctgtcacaaacaaaaaacaaaaaacaaagaaacaactagcacctgctttaactttccccatccacacccccccacctccgccatgtggctcatcctccctagtcaattgtagaaggatgacccctctctgacggttcctccagggccttttccccaaaggtggagagtcttagctgtcaccctatagaagcacattcccaaattgcaggtaaattatacatttgccttttaagtagcactttaagctggcagggagacagatttctatcagtggtgaatgcccacctcgggctgctagatttcatgcagggttcgtgtgatgggtaataactctcacctccctccctttatgaagagacatggctcttgtctttccgcacggagggaacaataacacacacatcttgccccgaggtctcagaggctgcgggctcctcacctcctgggtctggagcccacccaccagtgcctttactgccatggcaactgcccgtggggcctgaaaaggtcccatcatgacccctgtccgcggtgcccatgccaaagcagctgccactgttgttgtgcccgagaacacgaggatatttgctttccaataactgtcctcctgtttaatcgctggagagaggtgcttttgtcacctgctctataagtaaatggtcttggcatttttggcaacaggctcttctcaaagggggagatgcttccccctgggcagggcttctggagagaggaggccaagctgttttgcagaattctcctgggcatttgtccttcccgatctcctcccacacttcctcaatgggaggtgtctgcttcctaacccctctccagatctctgagccttgactgtcccagatgacctcctttccctccccagccagggctgaaccccccttccatgccatctccactgtgccttctcctgggaccctgctgaggctggaggctctgccaccagcctgggcacttgggagatgaagtctatggttctgctgtcaaaagcatgagcaccccaggctgtctaccatgtgaaaagacttcccagagacttctctgtcctagataagttgtgaaaagccaagatcaatttgcttctgaaaatcaggtagatcaatatgaatagcaccatctgctgaggagcacgtgtgtccatgagcagtgcatgtgtccgtgctcacgcaccctcgggggtgcccacacccccgctcccttcctcactctcccacccccaccctccccatcttatttgaatctgctcactatttcctgacttaacccttttttttcatttcagaagcaacaagacagtaaacctaaatcccagggaagtggctgtgtgttcactctgagtgcaggggacattgggatgtgcagtttctgggaggagggtcccctgccctgtgcacccccatctccagccccactcttctgcctcccaagccccaggcaaaatcatcagcctgtgactaactttgggggactaacatagcagccaccaggaggccagaggtcccaaaggctgggcaggtgtcactgaagtcccactgcctatcttaaatcacatctctgccctcaagaaggtatgtggtgttggatgtgggtgatgaaccctaccaagcttcaaggtcttcatctgttcatcagggatgatgcgatcctccacgggttcctgcctgacacagagcaagcacccaactaataacaacaacagccagcgcataggctgagcatccctaatccccaaatctgaactccgaaatgctccaaaatccgaaatgctccaaaatccgaaacgctccaaaatccgaaactttttgagcaccaacgtgatctcaaaggaaatgctcattggagcatttcagatttgggattttcagattagtgatgccgaacataatccaaatattccaaaagccaaaatccaaaacaaattcaaaagctgaaacacttctggtccccagaatttcggataatggatactcaactggtatttgccgcatgcttgtctaagtactttatgcatattaactcattgattctttgcaatgatcccatgattacctgtgatttttatctctcccactttagaaatgaggaaagagaggcccagagaggtcaataacatacccaacgttgcggagctagtaagtgtggtgtcaggatttgaacccaggcagtctgggtcttgcacctacatgctttgtcctgccattggtactatttttttgtgctgggtcaggctaggagtagagatgcaagcccaaagtgcattggctcagcccttgtcctcaagaatcttccccttcctctagggcacctccaaggtgaagagggaagaccccgggctccctaaggccttgtgcagacagaagcttcagccactgagaatgattgaaccacatcgagcctgtctttcccactatgctcagcagttttgcttggaaaatgatgatagagtaagatttaaaagcctggagaatggactattattcttatcagtgctaataaaggtgaaagcgtttcatttcctggtgtgagtgtggcttagacgacagaacgccttgctccctcctccccatgaactcccggcctccttgtctctggcatcttccgagaccctcccaaagcccgagctcctgagagcctcaccccatcaggaaccccagctctctgcagaagaaactcctaaaaggctagtagggcagagtgatggcaaagtggggtgcattgctccccttgggggttcattcagcaaacattcgtcacgtgcacattttgtcctgggcaacaagggtatttcagtgaggcattgcctcactctgatttcatttcagtaggggagacagactataaaaataaaccaggaaatagataatacaatgtaaggtaatgagccatgcttcaaagcaaaataaagcagggaaggggggctacagactaaggggaggagagtatattagtaacaaggcagaaagcagacccctcctcaactagtgtgatggggacaattaataaagggacaaagaggtggacagagtcagaggacccactcagggatggccagtcaccctggacccagcatcatgggaagctgcctgctgccacttctagacctaggagcacggaaagagaggagctgccagagctgagagtgggctgtcgctgtgaaagtgaccctgtggcccactaatgagagagctgagaagtcagtaccccaatctgattctcctcccgccttctggtctcctgtgggtgacttcgtttggccaaacccaactggaaggcagagggtaagggggcttggtcgatgcagcccactcagtcagcctcctgtgacacagagcagggtgggaaggacagggtgctggcctagagggtcaggcagaggctgggcagctccgggccactgctattccatatagaatggtcagagaagacccagtaatgaggggcctttgagcagaagcctgagatctctgttccccacctccactgacacgctctagacaccttcctctgctttattcttctctccctttgtgaccagccacagatccgtccttgccccttcaaaggaactagaatatcttcccccaagatccagctacagtggagactgaacataacagccaccaggaggacagaggtcccaatggctgggcaggtggcactgaagtcccactgcccatcttaaatcatgtctctgcccacaagagggtatgtggccttggatgtgggtgattaactcccccaagcttcaaggtctttacttgaagatgtgcgggtctggcttttcagggcatcatggcggcaagacgatgccacgtcttacagtggcaactgccagtggcccagtgtagtttctctaggcaagtggcagtttttctgaggtatgagggttaccctgggccagtggcagtttctttgggtcggtggcagtttctgtgaggtgtgagggtcacctccaccctcccccccgaccccactgctgctatgcagtcttcactaattcctgagagaggaggggaagccactgagacaagtgaacaaagctcaggccactctggtcccttcctcctctggcacattcatggggaatgacaggtgcagaggctcccaaaggaaggctcctccctgctcttctgtgccctggagagggctctatggccactttgggccctctgtgcgcctctcgagcacccacattctcttctcctctcctgcatgggaacatgaaggtgtttccttgcacactctaccacatgaagccacttgctcctcatccacttgcagcttttgcaatcacagcctccattcgtttaagactttttaagattcaccttaaaaaattgagtcaatgaggccacaaaattagaaacacgcacacacacatacacacacacacgcacacacatgctgattttcactgcaggcttccaaccttatacggagctgttgacattcctgaggctaagggaaggtcctgggagattcacgcccattctgctcctccatgctccatctcaggccacacagcagctgtcagcaggtcccccttaagacctacataacacccagagtgctctccaggtctgcaaagagaagagagtcttagattctttttcttgcctttgtgacagtctctctgttcctcagctatccctttgaccccagagcgccttctgatgccttttctctaagaggccctgtccccggggtgcaccactgcatgataactggctttgtataggttggcttttagacgctctgtgtgcttcacactcatcatccttttccgtagagttagaatgaaatgcaatcagctggctggatatccattgctcttggaataaatttcaaattccctaaagtgacctacaaagctatgcatgatgtgtctgtccagctccattacatgacccctccctctggctcactatttccattcatacctgtttcctttctgctccttgaacacaccaagaccctttctcctttttactatgtacttgccattctacctgcctggaatgatttaactccagctcttgtcatgcatgatggttcattgtcattcttcaggtcttaactccaaagtcccctcttcagagatgtcttccttccctaccctatcaatgaagtctctctctgcgcttctaggtcagtgtcctgctatacctctgactctttatttcacagcattcataaccatttgtagttatattgttggttgagtgttggtggcggtagtaatggtggtggcggtggttgtgtgtgggggaggggtgtgatctgtcttccccactaggaagcatattctttgaagtcaggaaccaagtctgtatttgtgcagtaaaggatcaactttacccaaagaaaggtttgggtctttggccctggctcctgggagggaacctctatgtccttggaatgccctgtttgataagagcatctttgtttacctggggtcttgggccaccctaaattttctatgctaacaatatgatttgtggtaggttgggggggtggtcttggaccacttggtataagcttgacttctggaaggcctagagactaaggtcaacctggcaggcagtcaatcgtgtctatgtgactgagccccaatagaatctctggacaccaagatttgggtgagcatctctggttggccagactctgtgtgtgttatcgcacatcattgctggaagaaacaggtgctgtccaaagttccactgggaaaggacaacagaagttcatgcctggtctctcctggaccctgccccatgtaccgcttcccttgactgatttccatctgtatcctttcaccgtaataaatcacaaccataagtataatgcctttgctgagttctgagtccttccagtgaatcattgaacctgaggctggtcttggataacccccaaacttttccattggtgtcagaagggaagtggtcttgggaacccacgaccttttcagtgttatttaccactatcttcttagtgcatagaaccacaagtggtatgcagtaagtgctcatgaagtatgtattgataatgaaggttcctcttgacacaaagaccttccaaatgcagccagtagggctgggacatgttctcaaccacctgcagcttcctcataccacctcattgagtttagccccaccaggtgtcttctagttcccagaaagtgctgagctccctcaagcctctggactcttctagaagttgtgtgtgttgtctggggattccttcatccaccacctccctgattcctcattgtccttccggatgcagctaatcttatcacctcccctggggaaaattccataggccccgagtttccaagcctacctgagcttacccatggcatgctgttataatctctgctgtaacacatggcatctgggttataatggaaaggagtctgagccttctcttcctagagctatgtcgcatttgcagaggatcttctgcttagatacctcttctctgtggcaggtggactctaagatggtctaagctgatccccacctcgtggcactcacgtttgtgtcatcttctctctttgaatgtgggccagactggcaacttgttctaaccaaaggaatatggctaacataataaatgtcacttgagctcttttaaatccaggaactgtgtgttttatctgtaggtctttactagcaggtgctgtgccgattgcatagcagcaaatatctgcatcaacaaacggatcaacccctcaacaaggagaggtggaaggaaggttaggaacatggtggaaaattgttttaaaatgatggttgtgtagcagatcttagcatcattttcagaaacaagattctatctactcattctgatatctacacaaaaggataggagataaaactatcaggaggtcatcctctcaataagcttctttggagtagaagtgagctgccctgcccataggtaggaaacccatgcctctaagctttgcagaatgttcacctaatcttagatttgggtcataggcactggagctggctaccctcttctctgtggcaggctgactctaaggtggtctaagatgatccttacttcctggtattcacattcttgtgtaatctcctctccttgaacatggtcttgcctggtgacttgttctaatcacaggaatatggcaaaaataatgattgtcacttctgagataagttttaaaagattgtaacttctctcttgctagtggactttctctcttgctggcttctttggtgcgacaaggaactgagagaagcctccagcctacagccagctgggaacgaaagccctgagcccaacaactgtcaaggaactgaattttgccaacagccacaaaagtgaacttggaagtgaagccttttccagtcaagccttcacaaatggcacagtgcccactctccagccctggctaacacctcgattgcagcctgagagacagtccaaagcagagggcccagccaggccacacccagaggccccacccacaaagactgagatcacaaatgtgatcgccttaagctgtgaagttttggagtgatttggggtgatttgttaaacgcggtagataactaacatgctctcccaagcgctcatcaacaccagatcatacctgactctgctgttagcagcacagtaagacagtcaagccatagacgccagagccatatggcctggattcaaatctcagggcctctactttgtgcctgtgtgaccttaggcaagttacttagcatcagctctctcatcaaggacataggaatattacctacctcttaggactgtcatgaggattagattagatcctacatgtacaatgcttagagcagtgataatatttgtaacattcatcctgtccattatatcatataagtgttgatggtatttattcttcacggctaagtttcttcatggtaagtttctacttacattagcacatgcaattgaccacacaccacccatacaacccagccctaccacaagccagtagaaggaaggccttggggcagacagcagccttctctaaccacagccaggaaggtcaaggcctggtcctggaacctcaaagctcacctcctcctctctgctcagcatcccgaccacccctgcttttggcataccaagaaaggagttgcacacacaggtctagtctgatcattccactatttgcaaacacatttacaaacagtcaggatccatttcccttgaatgttaaggggaattcaataccaaatcattacaattcaatcccattatggacagtcataacctaaaacagttctcggcaagaaaacaccaacgtagcgcaagccacagcttcactgcccccagggctcacagctgagtggtacctccagcctggaggactccagacttcagcccagtagcagagctacctgtgtccaggaagagggtctgttagaggtgtggtggtctagggcaggctcagtgcaagagtttgctctggagtcagaacggttcctcctgtagctgtcaccatagaaccaggccaactttggcaaatctcaaggtgtgtggttgctacagcacataggcctctgtgggtgtggtgtaagttgtggaggggagggagctggggagggaaaccagaaggatttccatccctcctgtgcaagggcctgagcacctctacctgggcttctgtaccttgtattttcccagtttgcactgggaagcttgccctagcctgcagtcaagctacctacaaagtcaacacaacatgcgagattgcctgcaggccagctgttcgtattagagagaagatggaaatactctatggcaggataagaggagaagaagcattctagaagcgggagtctgagcacaatttatgtcctgggccacagagagcctgtcactcgcttcccctgatagagtttgacccccatttactttgtaaaattgcttatgggcacgcagacacctctgaggattggtatcgccagtgttgccgcctgggcctctcctgggatatgaagccttgtgtttttgttctcccattccctcaaggtgatggtacagagatgttagaaaatgcaggaagctgcaagggcctgttgcctgcatgagacctggtgtgtgcatgagtgcatatgaatgaatgtgcatgttatggctaatgagcatccacagagattctcaggatgacaggatcaaataattgctgtcagagctatgcttctgattagctttctcttccaaaagctaattgtccaatttcataggcatctgctatttttcacaaatgtgtttgaacttcacaagccaagtgattttttagcagacagtcaacaactcagaaaataatacatcctgtatcctatcttgtccctctcaactaaacactgaagttatagaaggaaagctgaacagacgttcgatgcacaaacttgccaattagccctctcacaccagagtcagggactgtttttcactcgatgaatgtgttgaacccagtggggacaaagaacagcaggatgtgcgcaggcacagaatttctctccctaacagccggggcatgctcaaggagagccagagtgcagcagctgagacctcacacccgtgtggggctcgaatcagatctgcagtgtgcatgctgtctccaggcagtcatgttctttgaggtgaggatctcggcaggtttcatgccatgttcagtgggaaatgggattatacaggtttgcagcttgttacctctggcttcccacagccttcatgctgtgcatctgtgtcaggtaactcttgatggaccaaacatctgtagccttgcaaggaaacatccaatttccctagaatttacctaacttccctttccctcaatggcagagctactaaactaaagagtgggaataggcccgagcgtggtggctcatgcctgtaatcccagcactgtgggaggctgaggcgagtggatcacctgaggtcaagagttcgagaccagcttggccaacatggtgaaacctggtctctactaaaaatacaaaaattacccaggtgtggtggtgggtgcctgtaatcccagctactcagggggctgaggcaagagaatcacttgaacctgggaggtggagtttgcagtgagccaagatcacaccgctgcagtccacctgagcaatacagcaagactcagtctcaaaaataaaataaaataaaataaaataaaataaaataattaaaaaaaaagagtggggataaggagaggagtgtatcagtcaggataggaagagttaggctccagtagcaaacaacaccaaagtctcagctgcagaaacgtgaagagcccctttctaattcccgctatgtttccatggggctcttcccctgcatagtcatcatccttgctctggaatctaagctgatggagcagccaccaccaggaaatttgctgatcaccgcatggaggcaaaagacagccatagtgggtcttaccatcagcacttaaatccccagcccaaaatgacacaattcatcggccagaagtggccacatgattccatccaaccacagggggccagttagtgtacttctaccatacgcctggagtatggaagaggcagagtattgggcaaaagatggcacttatgaccatcacaaaggtagttaaaatggtccaggggctcattggagaaagcaacaaggaagcagattcaatacccttaagagataaactttcaaacttccagagacttctttgagtgaaatgaattaccagtggaggtggcacagacatttgtagaggtggttccaacaattattaggggtgaaattaaatctttaagatcccttccaaatgaatgaaattagcctccaccactcacctggtcttaaataatcttgtgctatggtttgaatgtgtgtgttccctccaaaattcatgttaaaatgtaatccccattgcaacagtattaacaggtggggcctttagaccctatgggggcatgcagacacctgcatgaatgggatcagtgaccttctaaaagggctagggggaaatagctgggccctttttgctctttttcatcccttctgcaaggtgaggccacagtgtttgtcctctcaggagaatgcagcaatgaggcaccattttggaggcagagacaaaaccctcgccagacactgaatctgctggcaccttggtcttggacttcccatcctccagaactgtgagaaataaatttctgttttttataaattacctagtctcagatattttgttatagtagcacaaacgggctaagacaccctgtcacaaggatttggtcattcagatttgcgaaggactagcaatctgaaagaaaaactgaaattgagagacagggttgaggttggagattcaggtgaggcaggtgaatacacgaactcctgttgtgggcttagttctccctttgttagctccatgtttatatcatggtgctcctgaggctaattatggttttggttcccaatctgaggtcacgtgagcttagatgtggatctttccccattggagccatcagatgagaccccagccctgggaaacatcttgattttagtttgcaagagactctgaaacagacgacctaggtaagccacacctagtttcttgacccacagatactgtgagataataaacatgtgttgctttaaactactatgtttcatggcaatttgttatgcagcaatgggtaactaatgcaaggaggtcaatcgaaggggagggtggcacaggtattagtgtttgagatttgtggctggatataagtcagagaggaaaacaagtaggctctgacccaagaagtttagatagagagtggcaagtggggtctcaggcaaaggggttggctagaacatttgctgagcctggctggggacccctaatacctgccaaagatgtcggtaaagtggagaggtctggagccagatggagaagtagcttaactttcaaagagcccaggccagctgagagcctcaccctgtcctactcatagatgatcagttgagtcatcctgaaatatacattcagaactatattaagggggccaataattgctaccacttattatgcacctgctatagctcaggctcagttcttttgccaacatgacctctattctcatgactctgagaagcaggtgtcattattcctatttgaggattagaaagtgaaattcaggcagaccaataacttgctgaaggtcattcagcttgtaagtggcagagctgggttcaaacccacattgagccccaaagccagtcctctttctcttagaattcattctcccacccaccctccaggcaatcagatgggccccaggaaaacctcacatcaagctgactttttccaccaccttgtcacgacccacttgcataatctctcagccattattattcctctcataaaacctcatccctattaaaaagtgtttcctcacccatcagcaccctgattgtaaaatataacaaaaaacctgtcttttgcttaatttcaagatatttatatgacactttgaaatgtcaaacgttttcattaaatcctctcacacttgggctgacaaagggacaccgggatctttgggagacactttaatctcaatcaattaggaataaagtagtcctagcagtgtggtgataaaagaacactttaattttagagctaattaaatatcaacaattggaatgcagcaacacttaacctgcagtaacccattatttattaggaatataatgcattgactctgggtatgaagtgagttgtagtattttaatatcagctgtcacagtccagcgggtcccttttgtttcactccagcatagtcatttcccaggctctgctgggatcactccagcaccctcactcaacacaagattaattaagctggagatgagcacacacacacacacacacacacacacacacacacgatggccatgagggtgccttgccccaggcaacacaaccccgagctggcaagagggcagcctaggcaagtaacagttgatccaggcatgtcagaagcctgagtcttggaatggacaaattaggatgcttttggctgcaagtaacagaaagaaaaagaccctgcctaaaagaacattaacaataagggtttattatcttacataaagaaaagcttggggacagatagggttgcaaaattggataaatctgaggcttgatgatattgtcagctactagcagctctcttctatccactctgccatccttcacaggtgagtgatgtcacttggtggcagctgcagctctctcccacatgcagggtggggtcttgcaaacaggaggacgcttctctctgtgcatcttttacccctcattcctttttgttacattttttagtttgtaatacatttagatgtaattaaaagctgcaaacatagcacacagagttcctgtatactccccatctagtttcccctcttataaactaaaaggcaggttttattcggatctcactaatttttccactttcttccctttttctgatccagggtcccacccaggatgctgcattgcagttagtggtcccgtgtcctcagtctcctctggtctatgataatttctcagtcttttctcggttctgacaatcttgacacttttgagaagtgccagttagggatttactagaatgtactatcacgtggctttgtctgatgtttttctcaccgttaactgaggttatgagctgttggggaagggaccacagaggggaagttgtccctcctcatcacactctatcagggggtacatgatagcacacgacatttctaatgatgttggccttggccaactgatcaggatagggtttgccagatttctccactgtagagttgcactaccgtcctctctccctgcacctttttattggtgaaaataaaaataaaaataaaaataaaaataaaaaaccctttcttaaagccatctagctcttgtccccttgaccccatgtccacgcctaaccaaacaccagcaaactgaatcaaataggttttaacccaccataattcacaccctggggctgtgggcgagtgggtggggtcatcatcactgaacacacttgctcaaacagagctcagctaagtgagaaggaaagaggggtggaaaggggaatcaaacagcagacgggcatcccacagtgccggcccctgaaagtcatctgcgtgaacatcactaacctgtcccagcagcttgccctatgcagtacaaaaactaatgaagggtagctacaggcaccaacagacataagcaagtcaccaaggaatagctccaggataacaccacaccacatcccagtgacagtgccggcttgggagccagactgcttggctggttcaaatcctgcttctatcccctgccagtggtgtgacctcgggagagttcgttacgtttcccatacctcagtgtcttcatcttaaaaatggggatgattatcataaagtacacatgaagctgaataaacacatagtaagcctgtgtaagtgttagctatgattccatttatattgagctcaataatgtgcaaaaataaacaacctgttgttaggaacacaatcgtgcatggtaaaactatatcgaggagtgtgaatgctatacccagaagtcagcacagggcttctctgttaggggagaactgaaaggaagacagatacccggggtcctcccagctcctataatcatctgtttcataagtggggctcacgggaactcactgtattaatttttctaacttacatacacatggctcattgtttccacaggtgagaattatttcataataaaagtaacctgtcaggctcctctgtgccctgtcttcagaggtgaggtggagctccctggagccagaggcaagctggactgctggttggtagctgcaggatacaaaccttccgctgacgatccacagagataacctgccctctgggtgctggagtcggagtcaggcccacgtaggtccaactccgtcatttttcagcagtgtgaccttgatcaagttacttctcctggtctcactgtttttagcagtaaaatggaaatgcagaggttttaaccctccaactaatcagggtttggaggaggatctagaagcaaggtcaatgaagatgttacctcttgagtcattgtgtttaaagcctccggcaataagctcgtgggctggctactccagacctccctggtatccctatttcaccatgcaaaggtctagttccctcccctcccctaacagccataagtttgcccttggatctatggctctgacatctggtctccatcagcatttgcagtttccatttcttggtctttgctcctggtgtgacttcccctgacctactctgatggctggtcagcgagctagatgatcattcatttctagaatggtctgccagactccagacccctgttcatctctggaaatgctaaagcactgaaggagtagaaagaattgaaacatatggctcacttcttactagatgtaagattttggacacgtccccatctgttcaacgaagatgacagtcactatcttgcaagaatttttgtaaagatggcatgaaataatggatgcggagtatttaaagaacctggagcagcatgatacattacatacctgatggttattaggtaggcaataaacaggagtaataattactacaatatccagcaaatatagtttacacttaaaaagaattggctgcatttttctttcacttttttccattgatttttacaagtaaatgtaatcaaggtcgttggctgatatcacagtttgcgtcgctaatttgctggaagccttctgaccatgtacctagaccttgatctgtgatttactgctgtagaaatggtaacagagaaaaagaaagagggaagaggtgacagtctacttttaaaatttcaggataaagaaaatagctggtctggcatcaaaatgaaggttgtcatgatggctgattctcacagcaaaatacgtgccttcttaagggaagagagaaacatgtttaactcaatcctgttctctgctctcatcagagaacagggcactggctctggaatggatagtataagcaaatgtggatatggggcataaaataaatgttaggattgcacctttagagactatttattccatctccctacttagaggaaaaactttgcctaaataaagtatggctacgaggttccttttcaagaccagccttgacttggagagtaattgacaggaacactgcattaagaaggattctgctgcacattcccggctaagctggaaagatggcatgatgggtggttatgtctactctgggtgcaggaggagagtcatggctgcatttatgggtctatgatcagttttccatggccttgaacctttcctggttctcttagttagaatttggaaacatggtcaagccacatggtcaccagtcagctgggtacgacgtaacagctgcaggcatcagacaggacaggctaacgttgaaaatcaggcagctctggaagagctccaaacccatattaacctctttataattaaattatttgtcctatggtccttgccgaaaaaaagcaaaggggcctcatgccatgtgtgatttttttttttttttttttttgagactgaatcttgctctgtcgcccaggctggagtgcagtggcacgatcttgggtcactgcaatctccgcctcccagattcaagcgattctcctgcctcagcctccagagtagctgggattacgggcatgtgccatcacgcccggctaatttttgtatttttagtagagacggggtttcaccaagttggtcaggctggtctcaaactcctgacctcaagtgatacacctgtctcggcctcccaaagtgctgaattacaggtgtgagccaccgcacccggccaccatgtgtgattttgaggggaaattctattgccccttccccatgctcagctattacctaaccctttcatgtgcctacagggattcatttctgcttcttgtgtctgctgttgtgctcagaaccaaacttccacccacgggggttcagggtcaaggacttggagttgcaggccttgttttatttactagctctccaattttgggcctcttactttacctctctaagcctcagtgttctcaactgtaaaatggggataaaaatagtacctacaggccaggcgcggtggctcacacctgtaatcccaccactttgagaggccaaggcaggtggattgcttgagctcaggagttcaagaccagcctgggcaatggtaaaatcccatctctatcaaaaatacaaaaaattagccaggtgtggtggttcacacctgtagtcctagctactcaggaggctgaggcaggaggatcaagtaaggctgggaggcagatgttgcagtgagctgagattgcaccactgcactccagcctggacaagagagagagactgtctccaaacaaacaaaaaaacaaaacaaaataaaaaaactacctacctcatagatagaacgaccacctaatttattgtccaaactgggacacttataaaaattcttcataattacatcaggagaaaggcatcattgggaataatcccacaaaaatctcagtgcgtggtgtcaccctccaaatggggacgttgtacagatgcaagcaggaaacgtagatacgttcctggaacagacggcaggagcatgtgggctgttcctggcttttcttgtctacacagaactttctactataattgtccccctctctttggcgtcattgttgtcttcctctctcctgggccatttcaccaacccataaacacgcattaatagctccctctttttttttttttgagatggagtcttgctctgttgcccaggctggagtgtagtggtgtgatcctagctcactgcaacctccgcctcctgggttcaagcagttctcctgcctcagtctcctgagtagctgggactacttagagcccaccaccacatctggctaattttttttgtatttttagtagagacagggtttcaccatattggtcaggctggtcttgaactcctgacctcgtgatctgcctgcctcagcctcccaaagtgctgggattacaggagtgagccaccgtgccccgcccagctccctctttaaaaataagaaaaacaatctcttcccagccctctcccctctctggccagtaccccatctttctgctcctctatagaaaaactcctccaaaactgcctatgtgctccagctccatttcccttctccaagggcttcttcttgactcagtgatagccgaagaccttccatggcctctacactctgcgcgacctgtcccctgctgatttctgtacctcctctcccactgcctccagacgacccactcttttcccatgttcctcagacacaccaagctcttcccaaactcgcggccttcgcattgaccgttccctctgcctggaacacctttccttatgtttttgcatgatcactcctttgctttcctcaggtcttggctctagccccttccctgcctggtttcttcctaatacttctgcatcctgaaattagatcatatgttatttggatgcagtgggatgtttggtctccctttctggaaggtaattttcagggtcagggacttgtttgctcacgactgtgtcctccaagaccagaacggtgcctggcatgtggtaggtgcccaaacagcacttcctgaatgaatgaaatgatacgtaattttatagtttacgattattcacagtatacactaacatcattagcaatagtgtatggagttaactggccaggatagccaagcacattggaggtttttttttgagttgactcctcctccccctaacctatcccttttgccagactgcatgtttcaggagggcagttgttccccgacctgggaggtgcttcagcccacagttttccagatgggctcattgcatttcctgggttccaagctcctcagatgtgattaccaccagcaggagcgccaacacagcccgcgagccctgcccgtccatcagggatgggaggcaggcagtccctgttgtccttcctctcaccctctgccctctcaggcttccactgagcattaatcacacagcctgaaggaatgcctgaagcaaagtccagttcagaggaggcccgctggcctgaaagaggaatggacgagaatacagggaaacctgccagcctccacccacaggcctggtctagctggctccaggttcatggagcccctctccagtctccaggaatgggtgctgcaagagctgagatcttagtccatcactctccggccaaaaaaggctgagttctggcaggtaaggctgctgctgaacagttaagataactatgcttcctgtacaccaccctgcatggcctgggtcctccgcaccttcccctctcaccatccagcattgaggtgcaccaggccagctggttgacctcttctctccccctagtacactgtgctccttgtcctgacccatttggggccttttaaggccccccattgtcgcagaacttcaggaataaagctggattgggcacccggtctgtctctttctggttctgtaattgaacaggctgtttaatccagggatcggcaaacatactctgccaagagctggacagtaagtcctttaggctttatggaccacatagtctcagtcatagctactcaactctgcccttgtagctcaaacacagccatggactatctataaaggagtgggtgttgctgtatgccaataaaactttattgacacgaacaggaggtgggccacatttagcccatggaccataggttgctgaccctgatttacccttctgacccagtttcctcacctataatatagggacaataatgccttaacatgaccactgagagttgatacaaacaaaagtacttacaactgcacaatcatgttgggtttttgtgttttatggcaatccctcaccttgcatccttgcccagaggagcggggcaggccccagcagtgcctcgctgagtgctgtggccaagcacatcactttgacttcgtggctgggagactgcgaacctcagactacctgcgttatgatttatttcagcgtgactagtatacatcttggttctgcagcgagtggagggaatgaggagggcctttcaagggaggcgggattgcattcgcacctgattacgctgcgcggacacaacagaggcgcccggacccgcagccctgccttcgccgcctttgctgggctgtttgcgcttcgtttccttctcgccgccccatggcgcgctttctctcttctttatttcgccggttctccccgctcctaacctgcttaacaacttacctcgctctcccgcttgctctccccccgccccccatctccactggttcccgagcttctcttcatgtccctaatggcgtggctgcgccagcatttaataaaagctgctgaccgggaaatccgagctaactgaattacttcctcattaaagaggcgggcagattcttgggccccgcgtgcagccaccctcgctgcctccctccccgccccgctccgccctgctggtcccgcctgccgtccgcaattaggcggcagatgcttgccgcccggtggtggcctgggttctgcagggactgagggggctcgtcggcttctctccagggtggatcccagctctgcttccttttccttccttctcagaccgtcagtttctcagccagggagctccaggccagctggagatcaggagaagagaggtggcctgctcaaggtcacccgagcctcctcctacccgagttccaacggagaccgctggctttggcctgggcaggggagctggtgattcctaagatcttcctttggcttcagagaagttggcttcctggcaaggcttccaggagattcccacaagccaactggagtcccccgagaaaaaggaaagaggggttggactccaaggatccatccggcgcctcctttccacctcccggctctgtgtctgtcaccggaccagggcctctgattccccgtgtgcccccattgggtcttccggggctgtgccagaggcctcctgtctggccagtaccccagggcgccacatccccaggccggcctgccggcctctcccctcggagttcccacctgcttctcttagcgagagcttcccgcgtcgagggctggctcagtgccaggcagctggtaagtgctttacaggtgttgttgcggagaaaaccagaaaccgttattttaaaagctggccatactctgagccttttactcgcaggcaatggaagatttactcgttcttttgtttaagaaaacaccttaatgggcctgttggcctctgggtaccgtctagatgggagaagattgagacaaagaaacattggcctgttctgcatcataaagtaaagggaagtttaggttccctaagctagggaggagtggaagggggcggggacagggaaaggaaccttgccaggcggataaagagggaagaaaacaggctggttacagcttagggagcctggatgctgcggtcaaacacagcctggaaaaaacaccttagaccctgaaactgccaccacccctacggaatcaggcgagacgctggccaaagctggatatcctacatcattgtaacccaagtttcttgtcttggaatgaagttcgtgcaagaagaagcccctttccgggacttggaatcctaaaccagtgccacttggtaactcttcactctgtctttgttctccagacctcccggtgaagtggttccggcctgtggttcttggagatccagctggtgctgctgtttgattataatgcagtagtttgaattcatggatgaatgtcctctgcattgtctcatgcgaaaggttcccagtaatcttgtttaggaaggactggtgaatgaattttgcttggaggaccccaggcttgggatgtggtagctactgccacagcctctactcttctggctatccagttaaggttaggccttcacaggagggggctgtgtgtctctgggacacctgttgacctaagtgctgtccctcctatggctggctgagaaaagacccagctttctgggggtctctctgtcagcacaaggcctggctcttcatccccgctgccacaccctcttccctggtgctgagacctgttgggagtttgggaaatcgtagccttggctgtttacccaggaaccttctctttttctcagtgggttgcaggagaacagaaagggaggtcaaagcgtgcttgcttgtgtctgcaggggaagactcgttcatgtagaggagtaaagcctaccccagtgccaactctgagacttgggaaaaatcaccgttttatcagagtttataccaaggcactatgaaattcacagatggctttgctctcctgtcttagtgtggttctctccaaaggagaccctgggacaaggacttggttgcaggtagcttatttggagagggataccaagaagctggggacccactcaggaatcatggagaacatgctttgagactgtccccctccaaaggatgggggagctgaagcctttatcctcagacttgccctgccttggcggagggttattaaattcacagtattgaattcccagcactttagggtgctcagtgcataggttgcacaggctgtgcaagctcttaaggcactggggaatgatcagaagcaaaacatcagagaaccccaggtgcttgaggtagaaggctgccagcacagacaggtacaggtgggaagattgcttgaacccaggaggttgaggctacaggtacaggtggacagagaggttatgaaaagtgtttgctataacccccaaccctaaaagccccagagcaaatttcagaaagaaattcaagtcctctagggctgctggtaggggtgcaaatgagttgggagagtgagttcctcatgccttccttatccacatagttccaaggtttccatcgtccaactacagtgtttcaacaaagagacatgctgggcgtggtggctcacgcctgcaattccagcactttgcgaggctgaggcgggcagatcacctgaggtcaggagttcaagaccagcctggccaacatggcataaccccgtccctactaaaaatacaaaaattagccaggcgtggtggtggtctcttgtaatcccagttatttgggaggctggagtgggtgaatcgctggaacccgggaggtggaggttgcagtgagccaagatcacaccattgcgctccagcctgggcaacatagcaagactccatctcaaaataaataaataaataaataaataaataaataaataaataaataaataaaaataaagtaaataaacaaagagacagtaaatgcctggagaatgaattaagacccatagttctgggtttttaatgggattgtcgaagagctagacccatgatgaatttaggaaaatttgggatagatatgacaaaagagtttatagccataatatataaagccgtgccatattcaataagaaagcaatcacaagctgacagagaaaacagtcaaattataccaacaggcagttcaccaaaaaatacatgcatattgccaataaataactaaaactatttctatctcatttgtaataaaacataatttcagacaaggtattattctttccccatcagattggcaaaaagtttacaagattgataccagccagggttggtgagggtgtggggagagagacattctcaggctgtccactcttttcagagacgagtttggcaatatgcattaaacatgaagggtgggcatgaaccttgaccagttccactgctaggcatgtaccccacagaaatatcagtatcaccatatatgcacaaagatgttacatacaaagaagttcctttcagttatactaacaaaattcgagccagtctaagtgtctatgagggatgtagttaaagtacagcacatccaggccaggcatggtggctcacacctgtaatcccagcactttgagaagccaaggcaagaggatcactttaagcccaggagtttgagatcagcctggacaatgtagtgagaccttctctatcaaaaaaaaaaaaaaaatcagccaggtgtggtggtgcacacttgtaggctcagctacttggaaggctgaggtgggaggattgcttgaacccaggaggttgaggctgcagtgaactgtgatcatgctactgcacaccagcctggatgacagagtaagaccctatctcaaaaataaataaataaatagcatgtacataccctggaatactatacagctattaaaaagaatgagagagacttgtcagaggtcctttaagtaatagaggaaggtctccgaacactattttattattctatttttgtaaaataaataactatatctacagtttgtatgtgtgtgcattgaaaatgatctggcaggttccacagcaaattgttaatgatggtgacctctagggaatgagatcagagtggggacaagcaggggaggtggtaggaggcagtggtgcagtgaagtggaatgtttttctatactcttacttggtttgttatctttatgatgagcaatttaatgaaaaccaatcaaatctgaaacacggggaataggtagaattgaaaaggattttagcaactctcagttcctgctttactttcctgggtcttcataggacaactccaggctcatttcataaatggaaagttgggcatcagagacatagtgtgaacccctgcccccctctagttacacagattctagggcccaggctgactgctttcaggctgatctctggaatggcttttaatgtataagtaagggagatgtatcagttagctattgctgtatgccaaacatcccaagtctcagtggcttaaaacaagcatttattattgatcatgcgtctacaggacaactggactgggttcgactgatctcatgtggaattactaaggcgtttgtgatcagctcgtgagctggcccatggtgggctggcccaggatctgggctttgacgccttggctccccttcaggtgcctctcgcatcactctagcaggctcgcctaggcatgttctcatagtgggagcataggtgtgtggtggaaatgcacaagcactttttcaagttgtgcttgagtcaaagttacgaccatggaccaaagcaacctcctggggagtgtgggaggtcatgacttcagggcctggatagagggaagccattcgcaaggccacaaacgcaatcagtctcctacaaagaccagctcaggacctgcagcagtcagaagggattggaggtgtcccctccccaaagctttggaagccttgctgccagagtccaagttctgagtcggtgctggtcactgcagcctggggataaagaagcccagtctttccgctgcaggaatggcccccacgggaaggcaagccatctccagctgtgattagttggagatcagcagtatccagccagcctcccaatctcacctggggtcccggcgacggggggcctgaggatgaaaggatggtgggtagtgggcaagggaggagggaggagttaaataaaacaccagagcaagccccagaggtgtgaatttgcccttggtcttcatctaacagggctgtctgcctcccctccttttttctcccatgtcctccacccacacctgcctctgaatgtggtgagccaggaactgattgcacagaaacttctcatttttagttttacctcaggtggttgcaaatctccttcctgctcagagatggggactgagcctgccccttggcatcctggtcctgctgcctgccccctccgtggccccagccccagcccccagcctggaccccatgctcctcctcagcactctgtcactgacagcgccttcgcaggctacagggactctggtgtggagtgatagattctgccttttcctgctttcaggaaatattgccattcgcttcgcatttatcctgcccctcatcaccacatggaggccgaggctgaggcgggctcgtagtcatctattatctgcctctgttggaggaggaggacaggcttgcaccgggagtgccaggaggtgggctggggctggggagatggagctctcattcaataagccacaaatatttattgggagtcggctgtgcacatagaagtgcaggtactgaaaggagagagaaaaacggtgccacagggccaggggacacaccctcctaccagactcacaatggggcaagagaggtgggacattagctgttagaggctgaaaccgcaaacacccctgtggaagtaacagtacaagagtgctagagggtgatttgaaatcaggtataaaaagctttccatatgcatgccctttgatccagcagttccacatctagaaattattctaaatgtgtacagagatgcgtgtacaaggtttatcagagcattatttatagcagagaaaagcaactgggaaacaagttctgcaacttatggtacatccatataatgaaatgccatgccaacattcaaatgcatgtggtagaaaaatatttatcttcaagacaaggtctcgctctgtcaccaaggttgaagtgcagtggtgtgatcatagctcactgcagcctcagcctccctgggctcaggtgatcctcccacttaagaaaaataattattggtatacagaaaaagcttgtgaaccatcatcaagagataacttctataatattggtgtgtataattctggccatttttatacatacacttatttattcacaaatgagatagtagtaattattctattgccttcctcatcccctcttcctaaaaggtctagggaagtttattaaaaaactaaatgggatcattgagagtaggggctgagagagctgtgaaccctgctggtcccaagagcatccacgttgtcacacagacctctaacaaacgatgtttatcacaagcaccttggagccaagcatctcttaggaaggcagccgaatgtgtgagtaatttagaaagatttccattcaaaaggaccccacaaaagtcgtgacagtaagagaatggagataggtgttactgaaactttaaatggttggacaaacaagggcatgtcctgatgttccagatgaatatctgtgcacctgagtataatcagcatctctcaccttcctatgagaatcgattttgttcacccctgtccctaggctgcggataccaaaggcaaagtccccaaatattctctgcctgccaggaatctcaaaccctttgaagggaaagcttgatggtgttaggaacgtagaggttttccagagaagggtctgttttggcaatgatggggtcagtgctaaacagtgagtccaagatggctgaatgagagcaggtgttctgacttcaggtgtgggctgcaatgatgactaaggagtttctggaagatccgtctggaccttgaaggttgagagaggtttcagcaggtaggtagggaaagatcagcaagacaagcaactgaggcttagagaggtggcctgacttatgccacaccagccagcttaagagggagccttgaacttgggcggtgctctggcttctgcagagccaggtgtacctcagaaggaccgagcctgaggaggggaggtgggagacagcctctcagctccactctgatgaaatgtcttgaacgtagttatcccgtgcagagtgtaatggagggaagtcctgcgctccgtgctgctcatttgcatgtgtaaatgcatgtgtatatatattgcttattaatgtcagtggaatttgcattttaagtggattgccttgttgggcatgttctttagagccctggacttgagcagaattttccaacttgaaagttgctgttccctgcgcaataagcaattgggctctttctcaggggccaaaaaaagggggatagatggttgtggtgtagaagaaggaaaggggcagtgaatagggtgtccagacaacagtgaccagtgactctgggcaggcagcagcttctctgtgccccaatctcctcatctgcactgtctcccctgcttacctcaccgggttgacttagaatcctgggaagatcattgtcacagtgggtagaaaagtggaagactctacagctataggggtgattatcattcccacagcccaaatagcagccattggtgcattctctgctgccagtgttcatatgtgctatctgtctccgcacctccacctggacacagaacctggcacatcttcgagtctttcctgctccccagacaactttaatcatcagcctggacttctctagagaggagagaatggggttgtcttgaagacacaagaacgaaaacatccacactggacattctgttctccaaatcccatgtgtcaggcccctttctccactcagcagctgtcccagtggtctctgctctggaaatgtcaattgcctcaactcctatgtgttgaacaatttgactacactccagcttttatgcccacatttgcaacccatcaggatgctgggcaaacaaaagggcctccagttcatcagacgccccatccagggaagggagttgggaccacagacctcaatttgcccattatttcaacaccagggcacttcacttcagcagtggaatgttgccttgtttcccaactcattagctcatctgctcgttgtcccctgatttgatgacaagaatctggcttcctgagcatctgagggcatatcacggctgtcatcacagaagtgacagtgactatgggcttgagtcaaccatgcttgtctgggcccagctgcagccccagagaacaaagaacactggtactaagggtaaccaggaggtgggagagggcagagagatgggggacagttagcttcgctaccagtctgtctgaagggtataaataagtggatacaagacacaaatctcacatgctgaagaatttcaaatcattgactttgttactccacccttatggagtagagaacagctcttcactccttaagtgtgggctgtgcatagtgatcttctttcaagagtatagtatggaaaggcagaaagaaaagagaagttttccagggtagaaacccagcatgactacctgtatgcacccttgataggatgtgataagaagattatgatcctgtgattaacttgggtgatatgttttggaggggaagatcactttacctctgtggtcttcccctccaaaacatacccaatctgattataggaaaaacatcagacaaaccccaactgaggaacgttctacaaaataactgaccagcatgccccaaaactgtcaaggtcatcaaaccccctcaaaaaagcctgactcataggcaggaggaggccagggagacgtgactaccaagtgcaatgtggtttcctggatgggatcctggaacagaaaaaaaaaaaaactacagaaatcagaataaagtatagactttggttaataataatgtattaatattggttcattatttgtgacaaatgtaccgtactcatttaaggtgttaataatagggaaataatagaggaagcagagtgaggaaaaaggaactctctgtacgatccttgggataattctgtaaacctaaaactgttctaaaatgaaacatctgtgaaaaaaaaacttggcaaacaatcaggatttgttactatattcaaacctcttcaactaaacaaagtggctgttttgttttaggttttctgcaccatcgtttctcactgatgttggcatcatcagactgtcaaaggctaaacagcacctttaagatgcctggcagcaagtccatccagcccaggagaaaatggtccaggccagggacatgctatttgtcagagaaaattacttggattgctccccactcctcatcccagggtgtgccccaccttctgatactgaaaagactcatctggggtatctacactctgcaattattgtgtagtcctaggtagtgtgcttatctccatcaggattcagtatctccagctatcagacaagcttggaagagcacagtcctcataggagagtgcagcaagcattaaacacagaatcaatcttactatactcacaaaacggattgcctaattcaggtgccacagacgtggaagctcccattagccccaactgtggatcttgtttgtctcaaaaccccagtatatcctcaggagccagaagaatatctgatgcatagtagatgctcaataaatcaatggttattctgtgctgggtcctgtgcttgtcatcattcactctagatgtcttcaatagcccctgacacatgccaccttcctccatgccacatcaaaagtcacatgtaatatgcaaacattaaatgttgatgattgaaacaccctcatcccataaacagtcctgccccaccccccacctcttacataacagatgagagtggacccctcccatcaagctgctcctctgtgactatgctcctttgctcaggactgggatgagggagatgactaatgtgtgacgccaacatgtcacgccacacaccgggaaatactaacgcataggcttccattccagcagtatggtgagttagatactttcacattccttttgaaacaactaaaattattgggggaaatttttttaaataccactttggaaatgcccatgtggcacatgaggaagggctccacagaacccccaaagtggaacagaaagtagccaagccaacttttaccctgagaatttctactgaaacttggagaacttggcttcaattcctccctccctccctctctccctttcttccctccctccctctttccttcttcccttcctccctttccttcctcccttccttcctctctccttcctttctttccttttctttctttcctttctctttctttttctttctttcacttttctttctctttctttcctcccttccctttcattccttccttctctttctttctctttctcttctcttctcctttcctttccttctttctttccttcctcccttccccttccttccttccttcctgtcttcagagtctcactctattgcccaggctggcgttcagtggtgtgattttggctcattgcaacctccacctcccaggctcaagtgatcctcccacctcagtctcctaagtggctgggacagaagctgactgcctgccactatgctcagctaatttttctattttttgtagagatagggttttgctatgttttcccggctgatcttgaactcctgggctcaagcaatccacccatcttggcctcccaaagtgctaggattacaggtacacaccaccatgcctggctaattttgtatttttttttagagatgggtttcactgtgttgcccaggctggtcatgaactcctgggctcaagcaatccaccctcctcagcctctcaaagtgctaggattacagacgtggccactgtcctggcctcagacttctgttttgatggttgtctaaaacagggcaacaagagaaatatcctcaatctaatagaagcacacatcaatctgggaccacagagagtattcatcaggtaaggatgagcaggcaatacacctgccacgtagaaaaaggtgaaggggaaacttgcttgacttgttcaaccttggcatttggggagggaggaaaacaaacttacttgagactgtgtaatcatgagccaatcttcacaagggtctatggtcatcattttagctacctgtagtccaaaaaacctcaagggggaaattaaacaagttgtcctagtttggtagaccatggcagaaaccaatgcaaatcccctctgggaaactctgcttccacatgacttacagaatacttacaaaattctaagaaatatggtggcccaaagtcaaaggtccccagaaattatcctgttaggactccaggaagacagaatttaaaaaaaggaaaaagagaatgagaaggtctagcatatgtttaatcaaaattccagaaggagatgatacaagaaaatgagaaaaagatagtattcaaaaagataatagctgagaactttcaaaatatttttgtaagacacacatttttatatccaggaagctctggtggtatctgatgctattcctggatgggaggattggtgccttgaaaaaatgtttggcacttctactttctacttcttcttcttagtttgtagaaagttgccaaaaaaaaaaaaaaaaagttgctctcctcctatcaagaaaaagctggataaattacagaataccaactcttcctggacccatcagagagatgaagtcacaaggtaactaagtagcctggaatccacaaaggagcaaggccctccaaggagagaagagatgcatgaatgacctacctccctcgtggcagaacaagggaggaggaggttctgcagcctaagtggcaaggagagtcagctacaattttaaagaaccgctgaaggccccgtgtgcactagtgtatcagtctgaaatagatgcaagcatctgctaaaacaggaattcctgtttactcacaggatatttcccacgagcctctgacgggtgctctgagaaagatttgggccggcaggacacctgagagagccaccatttgcagcgcagaccagcagaaggtgatcagctgccaccgtgaaggagacagaaaactctgccatttccctagagcttcctctcatatgaagcaaaagccttaaaccactagaggaggaagtgcaaacccttttgcccactgggcacaaagttagtgatcagtggctataggggtggagagagcaggtgcaacaccctgtccagacccttctctcctacaaagcaaaagccataaatcacttgaagagggagagcaaagcctcttgcacccaggcaaagacacaacgtggttaatgaaaagatgtaacaaaaactccaatgctgggtgatgagcaggtaactgtcttgggctcaagggcccatgttgatattaagtagacgtctcttaccactggaggaagagcaggaaacgcctgtctaagacccaccaaagcagtttgactactgaaggaagagaccacatggggcaacagtgctggaaaggctttacccccaaagctcaggtacacagagtctccctgagactaaagctggacaaggcaacagagaaccttcctgccccctccacaagcctatcagggagtacccagaaacagcagtctactgctggggaaggacaaagcatggagagagatctactttgtgacacaggcattgaaagactgggtgagttgagggtggaccactcacactgtgaaaaccctccagcacgccagccttgaccctaaatataggcaacagcagcacactgatcggaaacctggaagcctgcggtccaataatggtaaccatagcaacagcaaaatccaaatccagctcaacctgtagctagcatgactcacccctccacctaatgacccaaaacaagaagcatgcccacttccaggcatgcatatgatctatcttttgctaaccagttttagtgtgatatttgacattcaatcaaaaattatgagacattaaaaaagggcaagaaaacgcaaattatttaaaagagataaaacaaccaaaaaaataagactcagatatgatcttcatgttagaactatcagacaagtactttaaaataattatgattaaagtgctaaaggagctagtgaaaaagtgggcggcatgcatgaatggatgtagaatttcagctaagagaaagaaattgtaagaaagagtaaactgggaatacaagaaacaagaaaaaagacaaaatcagagaaaaaaatttcctttgatgggctcattagtacacccaagacagcaaaatatgtcaatagaaattacacaaactgaaaaagaaaaaggaaaggggagagaactggattagaatatatatgagctaaagacatacacaatggcctaatatatatataattggagtcccagtgaaaatgattttcaaaaatcaagaaaaactgaagacttttacagacaaaggccaaaagaatttattactaacaggtctgtactgttaaaggaagttcttgaggcccagagaatatgataccacacagaaactataccaaaaaaaaacaccttcaaaaatggtaaaaataaaggtaaatacaaaaatattattttctcatttttagttactctaaaaatagttgtcttgttaagcaaaaaaaagttatattttggagatattttggggtttataatgtggaaaataaaatgtgtatcatcgatagcacaagcataggtggaagaaattgaaagtatatagttcttatataatatagtgacttagtataaaactatttgaaggtagactgtgatatattaaacatgttaaaaactctgggacaacaactgatagttttatttatttttattttttgttgatatggggtctcactatgttgcacaggctggtctctaagctcctggctttaagtgatcctcctccctcagtctcccaaagcgctaggattacaggcatgagccaccacacctggctcagacttttcttaaaaaagtataataagccaataatggagataaaattgaatcataaaaattagtcacaaatcaggcagaaaaatagaaaaaaaagaagagatgagactaaatagaaaatatttagcagtataggaaaattaaataaaaccatatcagttataacactaaatttaaataattaaaatgtcccaattaaaagacaaagattgtcagactgcataaaaaagcaagactcaactatgtgctatatccaagaaacagaattttaatataaagacataactggttaaaagtaaaatgatggaaaaggatacactcatgcaaaccatgcaaatattaattgaaataactagagtagctacattaaaagtagtaaaggtagacttcagatcaggaaatatgaccgaaattaaagaggggcattgcataatgattaaggatcaattcatcaaaatgaaataatttaaaggtatatgcacctaacagcagtgcttcacaacatataaagcaattactgtcagagctgaaaataagtaaatacatccacgaatagagttagaatgtcaacattcctctcttattaattgattgaattagtaaacagaaaatcagtaaggacatagaagacctgaatgacattatcgaccaatttactctgacattttatagaacaacccaatcaacaacagcccgtgacacattcttttcaagtgcatgtggatcattccatagaatagaccatattcttgccacaaaacacattttaaaacaccgaaattatacaaagtatgttttctaaccacaactcaattagaaatcactaagagacagatatatgagcactcaacaaatatttgaaatgaaataatacacttctagtgagttgaagaggaagacacagggaaattttaaaatatgtttgaactgagtaaaaataaaggcaacatattagaatttgtgtgatgcagctaatagagtgtttggggaaatttataacattatatacctgtattagaaaaaaataagtgtctctgatcaattacctaagttttggctttaaaaacctataaaaggaagagcaatttaaatccaaagaaagcacaaggaaagaaataataaagataagagcagaaaccaataaaattgaaagaaaaaattgataaaaattaacaaaatgaaatactggctttctgtaaaggtcaatcaaattgataaacctctagtcagactgataagaaatcaaaagggaaagacagaaattaccaatgatgggaaaaaagaggagagctatcactccagagcctacaaatactgaacggatataaagaaaatactatagacaactatatgccaatacatttagtgacttagattaaatggacacttttcctcaaatatagaaactatcaaagcttattcaaaaagcaatagataagttgaatagtcctacatatattaaagatattaaatttataattaaaaactgcacactgtatgtagtcaaaaaccttcccacaaagaaaactgtatgcccagatggcttcatgtgctccatggcaagtttttccaacatttaatgaagaaataatgtaaacactacatcaacacttccagaaaacagaaaggaagtgaacacctcctaacttaagatgagaacagtatcacactgatactaaaaccaaacacattacaaaaaaaatacacagaaaactataaacacagaccaatacccttaatgaagaaaggtgcaaaaaatccttaacaaaatatttaaaaaataaattcagcagtatatgaaatgacagtacatcatgaccaagttaggagtttatcgtgggaatgcaaggttggtccagcctgggtgacagtgggtaaccctgtctcaaaaataaaaagaaaaagaaaaaaaagagaaaagaaaaaaaatgaaattttgaaagttttttaaagtaccacttacaatattaccaaaaccaataaaatacatgtataagatttatatgctgaaaactacaaagcacggataggagaatcaaagatctaaataaatacatgatgatatataggatgtgtcaagatgtaaatttccccaaaattgatctataaatttgctacaatcaaaactcagcagacttctttataaaagtcaacaagcttatttaaaaaattcatttagaaaagtaaaggaactagaattgccgaaacaattctgaaaaagaacaaatttggaggcttatattatttgatttcaaaacatactatatatctacactaataaagacagtgtggtaataatgaaaacatatccagaaacagggccataaaaatatggttaactgattttcaacaaaagtgccgaggtaattcaatggagtatggattatttttcaccaaatagtactagaataatttgacatctatgtgcaaaacaaagtctttgacacataccttacacaatatacaaaaaataatttgaaatggatcatagacaatgtgagctctaaaatgataaacctctagaagaacacataggagaaaatctttgtaaacttgtttttattttggaaagaaaacaaaaagcacaaaccacaatgaaaaaaattaacaaattagatttcattaaaatctcaaaattctgccttttggaaaggcatgtttaaaacataaaaggaacgagccatataggaagagaaaatatttgaaaaatacatgtctgataagactgtaaccagaatacattttgatctctcagaactcaattataagaaaataacctaattttaaaaacgttttaaacttgttaaaagatttgaacatatatttcatgaaaaaagatatactgatatggtttgcctgtgtcctcacccaaatctcatcttgaattcccttgtgttgtgacagggacctggtgagaggtaactgaatcatgggggtaggtctttcttgtgctagtgaataagtctcatgagatctgatggttttaaaaaggggagtttccctgaacaagctctctctgcctgctgccatccatgtaagacgttacttgctcctccttgccttctgccatgattgtgaggcttcccaagccacgtggaactataagtccattaaaacctcttttcttcccaggctcaagtatgtctttatcagccgcatgaaaatggactaatacttatatacatatggcaaataagcacataaaaatatgctcaaaatcattaatactagagaaatgtaacttaaaagccaattagatatccatgcatacctattagaatggctaaaaaacaaaacaaaaataaaactttgacaataccaaatgctggcagggatgtggagccactggaatccgtatacactgctagtgggaatgaaaaatggtacagccactttggaaaacagtttggcattttcttataaagttaaacatatgctgactgtatgtggtaggctgaaaaatggccccctaaaaggatatgtccacatgctaatccccagaacctgtgaatatgaccttatacggcaaatgggtgagtatgatcttatatggcaagagatgtaattaagttaaggaccttgaaaatagttaattctggattatcccagtgggccctaagttcaatcacatgtatcgtcataagagagaggtagagggcccgggtgtggtggctcatgcctgtaatcccagcactttgggaggacaaagtgggctgatcacttgaccccaggagtttgagactagcctgggcaacatagtgggacccgatctctacaaaaaaatacaaaaattagcccggcatggtggtcccagctactcaggaggctaaggcaggaggatcacttgagcccaggaggtcaaggctgcagtcagccgtgattgcaccactacattcgagcctcagcaacagagtgagaccctgtctcaccaaaaaaaaaaaaaaaaaaaaggagaaagacacgcagagggagtctgggacagagacagatgcacagggagaaggccatgtggagatggaggcagagattgaaattacgcagctgcaagtcaaggaacatcaaagttcgaccacagccacccacaggtgggagagagtcatggaacagattctcctcttagagcctctgaggtactgcagccaagctgatgccttgattttgaacatctggcttcccagaactgtgagagaatacactgcagtcgtttgaagcaccaagtttgtggtcatttgttatggcagcttttgggaacgaacgcacgagataaccagaaaatctccctcacacatatttacccaagaggaatcaattcatatatccaaacaaaacccttacatgaatgtttagaatgactttattcataattgtcccatactggaaacaaccaatatgcccatcaactggtaagtaaacaaattacgattcacctattcaaaggaatactacacattgattaaaacaaaacaaaaaacaatgatacatgcagcaacatggactctcaaaagcaccacgttaagtaaaataagtcagaatcaaaaagctccatgccacatggtcttatttatgtgacattatggaaaaggcaaaaatgtagaaataggagacagataagtggtcaccagaagcaagggatgtggggaaggaactgattatcaaggagcatgaggaaactttttagggtgaggcaatggtctatgttttgatggtgatggttaaatgactgtctggatttatcaaaattaatagaactgtatacctacaaggaatacagtttactgtatataaattatgcctcaattagcttgaaaaaatgtacgaaatgccaaagcaaaagaaattatcctaaaagcatcaagagtgagaagacagaaaacttacaaagaaacagtcattaggctggtggctcacttttccacagcaacattggaagccagaagaccatagaataatttagcttcaatatcctgaaataaaattactgccaacctaccattcaatattccatgtaatcagtcagagtctgtcagcaaaacaaaaataagtctaaatattttaagcaaaaaaaaaaaaagaaagaattaacataggaaattaggtgcttgcaaaattgttggaagcactggaggagtgagactcagatgttgcaggtgataaactcagaaatcagaagcaagaagctgcaggggaggccccaaagctggaggcagagtggaccatgaagtctgtgcatgctcttggaaactgccatcactgctgatgcgtccactggcactgccagaggaaggtttactgccaacttcttcatgccttccaaatctcaagcaactagaatgctgatggcagggaattctgaaattaggggagtgaaactacagcagtagttagaaaagattatagcaaataactttggagatgcgatcagaatagccttatgtgattcagaagaaatggaaaggtattggttaactttaagccttattaaaccaagtatgcatacaaaataactagaataactccgaaattagatgggcatagagtacataatcccgaaatagatgggaaaaatggaataataattaaaaaaaaagaaattaaaaagtcattctaaaagaaagagaaatacaaaaatccagatgaaaagcatattaaagggatagaaattaatctaaatgcaggttgggtgtctataatctgaaaattcaaaatctgcgatgttccaaaatccaaaactttttgaacacttatatgatgccacaaactctacacccaacctcatgtaatgagtcgcagtcaaaactttggtttcatgcacaaaattatttaaaatactgtaaaaaattaccttcaggctataggtataagatgtacataaaacaaatgaatttcatgtttggaattgggtcccatcctcaatatatttcattatgtatatgcatatattccaaaatcacttctggcttcaagtattttgggtaggggatattcaacctatatgcagtattcataataaataagaatgaattcaatttttgaattaaaagcccaagattatcagactattttctttaatctagcgaaatgtggcttagacaagacagaaaaaacatgaagtttgaaggtcaaacataaaagttaagtttaaaaagggaggaagatttaacaagaaaatactgaacaaaagaattctggtgaagttatattgatataagataaaacagacttttagactaaaagtattactaaaaacattgggactttctacataatgataaaatgtttaatcaaaaaaatgtaataattctaaactttcatgcaccagaaccaaaatgcaaaatatgtaaagtaaaaattgacaatactacaggaagaaatagaaaagcacaatcataagtgagagatttttatttatttatttatttttatttttggttttttcagacaaagtctcactctgtcaccctgactggagcacaatggcgtgatctcagctcactgcgacctccgcctcccaggctcaagcgattctcacacctcagcctcccaagtagctgggattacaggtgtgcaccaccacacactcagttttttttttttttttgtatttttagtagagatatggtttcaccatgttggccaggctggtctcaaactccccacctcaggtgatctgcccacctcggcctcccaaagtgcaaggattacaggcatgagccacagcaccaagccaacatagagatttttaattcatccatctcagtgattgatcaagcagacaaaaaaattactaagaatattaaaaatgtggacagtacaaatcagaaagctcttatggtcatatatagaatactgtgcccaacaatagaagaatatacatttgtttcaaagcatacatgaaatagttacaaaaattgactatgtgcttgaccacagagttagcctcaacaattatatcatattatctagctctaatgcactcaagtaagaaatttaataataaaaatatacccattaaaaatctatgtctggaaagtttacaatatctaagtactgatggctttaaaaaggagttataatgaaaatttgaaaatagaaatatgaataactgaattataaaattatttcatataaaaattttgggggtgcagctaaagcagtatttagaggaaaatatataactttagctgcttatattagaactaaaggctcaaaattagtgacttgagcattccatttaaaaagtcaaaagaatagcagaataaacccaataaaaacagaaagaagaaaatattcaagctaagaacaaaactaaaggcaaaaataaagttcaataaaaagaaatgtcaaaaccaaaaattggttctttggaaaaaaaaaaaaaaagcttttaaaatgaccattccttagctagcaagattactcagaagaaaataaacaggatggggagtggagagagaaagaatgaaaaaataaacaatattaggaacaatattaagaattaaaaagggcttattactgcaaaagctgcaattattaaacagatgagacgaggttaagaaaaactttatgataaattttaaaacttagataaaagtggataaattctagaaaaatacaatttatcaaagaagcagtagaaaacctggagagtctaatgacctttaaagaaattgaattattagataaaaatcttccagaaaaaaaaaaaaactaggtccaaatgatttatcagcaatttctacaaaatgttttaggaactacttttccaggtcatagaaaaagaagaaacctgcccccatcagtttaaaagattagcaaaatcttaattccaaaacttgacaaggatgatatgggcaagaaaaatcagtctaatctcatgcaaaaactgcttagtaaggatagaattgatcattttgcagtaacaaatttcaaaatgtcagtggtcttgcactatggaggtctggttctcttccatgtcacagcctgttgcaggacaggcagctccgctccaggcagtaacacaggaacccaggctgcttctcttttatggctataccgcctagaacatgcggcttccaaagtttccacaaaaggggaagtgcaggctggaaaatcgtgggatgattttaaggtccatgcagagaagtgactacaccattgttgaggattgacttgtgtcctccaaaattcaattattgaagtcctaaccccgagtacctcagaatgtgactgaatttggagatagggtctcatgatgttttaaattatttaattaccacttttaacagggtctcactatgtttcccagactggtgtcaaactactgggctcaagcagtcctcccacctcagcctcctgaagtgctgggattacaagcacgagccaccccacccagcccataaaatattttttatttgtgacttttacatctctgttcatgtggcagaaaccgcacaatgtgcttagcccaccacttccttttcctggacataaagaagtggtaattaaaataagttcataggggtgggtgctaatccgatatggcgggtgtccttataagaagagattaggacacagctgttcatgcatagaggaaagaccatatgaagacacagcaagaggtcggtcatctgacagccaaggagaggagcctcagaagaaaccaaatctgctgaccctctgatcctggacttccagcttccagaactgtgagaaaattaacacctattgtttaagctattctgtctgtggtattttgttagggaagccctggcaaactaatccaattatcattcccttagtaggaactcagtcacatggtcccaatctaactgcaaaggaggctggcagatttgctcttctttatgtccaggacaaggaaatggtgggctaagcacattgtgtggtttctgccacatgaacaaatatgtaaaagtcatgaacaaaaaatcttttatgggctgggtggagtggctcatacctgtaatcccagcacttcaggaggctaaggtgggaggattgcttgagcccagtagttcgagaccagtctgggaaacatagtgagaccctgttttacaaaaaataaaaaaattagccgggctttgtggcacatgcctgtagtcccagctactcaggaggctgaggagggaggattgcttggccccaggatgtcaaggctgcagtgagcagtgatcacgtcactgtactccagcctagatgacatagtgagaccctgtctcaaaaaaaaaaaaaaaaaaaaaaaattcatgaacccattagaaataaacccaacagaaaaatgagcaaaaacataaataggcatttgctagaaaagaaagcaaaatggcccttcaccatatgaaaagctgtggctcccggctgctactccaagcgtggcctgcttagatcacagtggtatcctttgggacatgtctgtaataaggaaaatgaaaagcaaaatcctacagagataccatctcatacttaccaggttggtaaaatgtaaaagtttgtcaataccaagagatgatgaaatgtgggccaacagaaactctggtccttcactagggtagagtgggaatgggcataaccattttggaaaacagtttgcctgttcattgtaagatttaatgcatggttaccttaggatcaacaactctacttctcagtgtaaacctaggtacatagagcagtgcttatcaaactctagcatgcatacaattttgctaatatgcaaattctaattcagtagatctgggataggaccctgaaaatctgccactgttctgagggctacacttggagtagcaaaccttgagtttcataaatccatattcacagcaatattcataatagctcaaaccccaaatttccaccagcagtaggctgggcaaataaattgcagcatattcatacactggagtattatttagaagtgagaatgaatgaaccacaaacactcacattaaaaatagatgaatccaacaaatatattcttgagcaaaagaagcaaggcacagaagaaaatatacagtatgactccattatataaagttcaaaactcaggcagagctaaataatacccaggcacacctaattttagtgtgcttcacaaatattgcatttaaaaaaaaaaattaaaggtttctggcaaccccgtgtcaagcgagtctatcagcatcatttttccaacagcatgtgcccactttgtgtcttgttgttatattctgataattttcacaatatttcaaaccttttcatcattatatctgttatggtgatctgtgatcaataatcttcaaagtcaccattgtaattgttttgtggtgccacaaactgtgcccataaaagatggcaaacctcatcaataaatgtgtgtattctgcgtcctccaccgaggagctggtccctcatctctctccttctcctcgggttcccttattccctgagacacaaaaatattgaaattaggtcaattagtaaccctaggtgttagggcaattaataatccaagtgttcaagtgaaaggaagagctgtacctctcccattttaagtcaaaagctagaaatgattaagcttagtgaggaaggcctgtcaaaagctgagacaggtcaaaagccaggcctcttgcatcaaacagccaagttgtgaatgcaaaggaaaaattcttgaaggaaattaaaagggctactccagtgaacatactagtgataagaaagtgaaatgcagcactattcacaatagcaaagacatagaatcaacctaggtgtccatgaacgctggattggataaagaaaatgtggttcatatattccatggaataccatgtggtcataaaaaaaaggaacgaagtcatgtcctttgcagcaacatgaatgtagctggaggccattatcctaagtgaacagaaagagaaaatcaaatactgcatgttctcacttttaagtgggggctgaacattgcatatgcagggacataaagatggaaacaatggacactgggcactccaagaagaaggagagagggacgggggtaaaggctgaaaaactccctctcaagcactatgctcactaactgagtggtgggttcagttgtaccccaaacctcagcatcatgcaatatacccttgtaacaaaacctgtacatttaacctctgagtctaaaataaaagttgagaaaaaaaaaaaaaaggaaaatagacttattgctggtatggagaaagtttgagtggtctggatagatgatcaaaccagccacaacattcccttaagccaaagcctaatacagagcaaagccctagccttcaattctataatgactgagggaggtcaagaagctgcagaagaaaagtttgaagctagcagaggtgggtttaaggaaagaagccatctccataacctaaaagtgcaaggtgaagcagcaagtgctgatggagaagatgcagcaagttacccaaaagatctagcttcataattgacaaaggtggctccactaaacaacagattttcaatgtagaggaaacagccttctattggaagaagatgccatctaggcttttcttagctggagaagagaagtcaatacctggcttcaaaacatcaaaggacaggctgctctcttgttagaagctaagtagctgatgactttaagttaaagctaatgctcactgacctttctaaaaacctatgggttcataagaattatgcagaatctactctgcctttgctctgtaagtgaaaccagaaagccttttgacagcacctctgtttacagtatggtttactgaatattttaagcatactgttgagacctactgctcaggaaaaaaagattctttcaaaatattactgctcattgacaatgcacttggtcacccaagagctctgattaacatgcacaaaattaatgttgtcttcatgcctgctaacacaacatccattctgcagcccatggatctaaaagtaattttgatgttcaagtcctactatttaagaaatacatttcataaagttatagttgccataagtagtgatgagcaacgtgaattgaaaactttctggaaaggattcaccatcttttcatctagagactctgtcttctagatgccatttgaacatttgagatttatggtaggaggtcaaaatatcaacactaacaggagcttggaagaagtggagtccaacctgatgttgaggggtctaagatctcagtggagaaagtaacagcagatgcagtagaaatagcaagagagctagaattagaagtagagcctgaagatgtgactgaaatgctgcaattcatgataaaacttgaacagatgaggagatgcttcttacagatgagcaaagaaaatggtttcttgagatgggatctactcctggtgaagatgctgtgaacattgttgaattaacaacagaggatttaaaacattacataaactttattgataaagcagaggcagggtttgagagaactgactgcagttttaaaagaaggtccactgtgggtaaaaagccatcaaatagcatctcatgctgcagggaaatctttcatgaacggaagagtcactggatgcagcatacttgattgctgtcatattataagatattgctgctgggcatggtggctcacacctgtaatcccagtgctttgcgtgaacaacatgggaggaatgcttgagcccaggagtttgagaccagcctgggaaacatagcaagaccccatctgtacaaaattttttttaaaattagatgagcataatggcatgtgcctgtagtcccagatactcagaggctcaggtgggagaataacttaagcctcggagttcaaggctgtagtgagctatgattgtgccactgcactccagcctgggtgatacactgagactctgtcttcaaaaaaataaaaaagaaattgctacagccaccccaacccttggaaaccaccacccttggatgatgatgtgagcagccatcagcatcaaagcaagaccctctgccagaaaaatgattgacttgctaataatcagaggattgttagcatttgttagcaagaaagtattttaaaattaaggtatgtacattgtttttaagacataatgctattgcacattcaatagattccaatatcgtgtaaacgtaacttttatatgcaatgggaaaccaaaaattttgtgtgattcactttaatgtgatattcactttattgtggtagtctggaacaaaacccacaatacctatgaggtaggcctatattgtttaggaatatttatataccttgtaaaactttgtgaaaaaaagagagagagagagaaggaagaaaatgcttaatatgaagctcaagacagaagttacctctggtggagggaaagaggaaggtgataggaaataaatacctaggggccttctcaggagctgctaatgctctatttctcaagctgaatggtgaatacgtgggtgttttattattactctttaagcagtgtatatatacattacactcttttgaataaaaaagtaacaggaagcctttttgtatttaagtccccagtgactagtaaaataaatctagtgggttatgaaaagtctaaattttgagaatcaaggagtacttgcacctctgaaataaagcatgcagacatctcagtttgcaagtcatgccatattggacacccaggaaataagatccgggacacgcaccctctttccatctaagactcccagcgacagacaaggagacaggagggggcaggactgcagagtaagtacagaaagctaactgcatccacgtgttgacatggggcagagtgggccagtgcagaggatgcgggtgggtaacttcctggaacagcaggagagaagagaaaaggaacagggggaagggctggagacacatcatctcccatgtcatcagtttgggaagctctttggaaaagcccacgtttactttctgaaacctcatcaaacctttcttctactacctttaaaagaataccccacctactggctgtgggagccacagccaggcagctttaactcttgagacactcaagattctgcggtctggggcacagatcccccgattccaaagcctgtccctcccagacaggtgtggtacctgggccagacttctcccacttccatgctagggagctccttttttgcagcagctctgcttgcaacttccaccccatgtaagggtgatgatgagattggatttcaactgagagagaagcaagttataaatacatcctggtgtactattaatgtcaataatattagtacaattatttccagactagtcagattcaataaaagcaacagtaaacaagcctgaggcagccaccaggtgagcgctgtgggggctgcacagctggctggctgctgaggacgatgctttgcctttctggctgtctcttgagcaggggaagccatggtgtttggctgcagttctgccagcgcctgctcacacacccccaggtcctgatgcctttaagtaactgagcaaagcagccatctccattcgtagcaacaactgtgccacatgtgaaagaaggagagagtttgagcactataggctactcacaggcgatacgtctgcaaacccagagccaagacagtagagtccggctttgcagactcgccttcctgaagtccttggaatgctggcattccctctagcacttctccctgctttgtaattatccatttacacgtctatcattccactcaattctgaattctctgaggacacggaccaggaatccctactgcccaggacggtgtgcagtgcagaacaaggctcagcaaatgttgagttgtgaaatctgggaggctctctcctggctgtttgggaagtcaggtcctttagaggctaagaatacaggcctggagtcagctgggcatggaattaaaggccttttctcccacttattggctgtccaattttgggtaagttacttcgtatggtttggctgtgtgtccacccaaatctcttcttgaattgtagttcccataatccccacgtgtcatgggagggatccggtggaaagtaattaaatcatgggggcagttacctctatgctgttcttgtgatggtgagtgagttctcatgagagcttattgttttataagagcctttccccctgctttgctctgcacttctccttgctgccatcatgtgaagaaggacgtgtttgtttccccttccaccatgattgtaagtttcctgaggcctccccagccatgcagaactgtgagtcaattaaacctctttcctttataaattacccagtcttgggaatgcctttattagcagagagcagagactaatacattactcaaccattctgtgtcttggtttcctcatctgtaaaatggaaataataatcatctttgctttatagggttgttgtgaggattaccagaagggataaatgtcaatgaaagtagcatggtgccaggcacatataggtgctaaataagcatattgctatcattattattattttaatgagcacattattatctgtgattattagagaggcaatatggcagagttcataagagccagactcccggggttaaattcctagttcagcccctttccagctgtgtggcctagggtcaccgtggatgactgggctagaatagggtgaggcaagtgaggcacctaggacgtaaaatttaaggtggctcctcacctgccaccctctcatcctgtccctattgaatgagccctttgcctctctatgctacatcataagtgataaatgaatgttagcttcttctatggataaaatgagtttccctagaacaactgtctatgtagcggtctgttcggctgttgtatcagaagaataaagctgagcccatgagcaaacacagtgggagtaagcagttaagggcgttcagtgatggagaaacaggggtgacccaaatgcctttctcagagtgcccttgcccatttccaatcaactgcgttttcctagagtttgtgtgagtgggtttctgtaccttgcaaactaaaaacactctctgactaagcagtgatagaaagcaccagaaagcaagctgggaatcacatccaggaggccttgcaggccatgctaaggatgtttggtcttggctcttgctggctactccatttctgatgttgttcttacttgggaaatcacgcgcacaacaacccccttgaacacccactgcccgggcaacttgctcccccgtctgctcacccaggttcctgtttcctcctggctacagaagcaaataagagaagagggtcaccgagggtgctcctatgcagagaacataaaacattcggcgctggcttctctccaatcagaaagagatggtgtccactttattattaaaaaggataaaacggtcttcccagcagctaccgacctgggactttaaacacatttgcatggaacattccctctggcaccatcctggagaatgtctctggctctcctgctctctacaaaggcctgtatatcttttccttgggcctttccagctgaattttaaagagggttttagagagcgcgtcatgacaagggttcttcagagtcttctaaatcataacgcacagaaccgaaagagggctatttcttttcctaagaatgatttgcccactctgattcagtgattcacccaccccaggcacaggctaagaaactttgcaaaaaaaatgagaaacttcccatcctcaatttttcctccccaagaaatccctctcaatctcctctcttttgctctcccctccctcttccctctcccccctctctccatcataaaataataaaacaaacccaagtgcatgtaaatccctcgcagttgctgtagagggggccagccagatgtatttactactaagtggatgcaaattcacttactgctgattttcaaagaaatgagccgcccctgccacaatattgcttttctcatcaccaaatggggcctttgctttgtaatttggtgaagctgtcaaaacaatcagatctaggaggcgggatggtgtctgcgttttggcatcccaagagattgatctcagtggttgctccaggcagctccactcagaaatgtgctccgtgggggaggccatctagggcgtgtcatggaaagagatgggttagctgggtgtggagcacagggcagagccaaggtcaggatgggctagacctccaggttcctcagctgcaaaagcagccccagggagatgtggttctggaccacccaaggggctgcagaaagaaaggtatcgacacacatacttgttcaaacctgtactcttttctaggacttcacaggtccactgggccacagcagccggtccatggactccagatctagaacccatgctgggtagaaaccccttcaactgctcaggcaagtcattggatctatctgagcctgactggatttttcatttgcaggagaaagttgacgaatctgtccccatgttcctctcaagccctagttataggacttctgaggtaaaggacaagttgggagagtatcgtagttgggctgttctggaaagggatgttagtcctcctggagctggttactagtacaggattcttggggttacaaatgatggaaaatcaagtctaactcaagaaaatttgcttcatgccaccagaaagctgagagtattggttttctaattgctgttgtaacaaattaccacaaagtgagtggattaaaacaacataaagtgttattttgcagctctggaggccagaaatccagaaatgggtttatgtggctaaaaccaagatggtggcaaggctgcattccttctaaaagatgtagggaagaattcattccttgccttttgggttctgagaatgcctgaaattccttggctcacagcccacttccagcaatggcataactttgacctttatttccatggccacatctccctccctgactctaactgttctgcttccccttgtgataacactgagccaacccatataatctggggtaatctccccatctcaaaattcttaatcatatatgcagtaccccttttgtcatgtaaggtagcatattcacagattctagaggtgaggatgtggatgtctttgggggccattattctttctgccaactttggggagcagacttcaggtgctcctgaagatccagcacaaggaagagggtgcaagtggctcaaacagtatcatcagggtctttctttcatctttatctctgcagtctgcttccttcatgttagtcatattctcaaggccatttcaaatagctttccccctgctagccaagaaaaatgctgcctctagccctcaattatggcatttcagattagtagatattaatagtttgggaaaaaataatctttccccctctatctttctctctgccctggtccaaataccagtctctgtgtagatcccttgaattaacaaagggatgcttgggaagaagggcaccggggagatatacaaatccttgagacagctagggtgggggttcatcaacctaatttgtagattaatcagcatgtacccatttagtaatccaagctggtgatgccagacacatcagctacaaagtgctctagcagcaagcctggtcattatttagtctcttatagatcaggccaaccacacagagcatgtgcaggaatcccagccctgctcagcccagagcattgacatttgtggttaagcagggccccatggaagccacacacccgtcccccttggtttcaccacgtgtctctgtaactttgagggaaaaggaccctccctcctgggatgggatgataattaagagtaatttcagtcctgttgggctccagttacaacaattacagggttctggatcaattaatactcacatttgcatggagaagatggtgaaatttagaatgtagaccccccatttaggagctatagctagggtgaccctacagccaggtgtgctagggacagtcgtggtttgcacctgaattattcatagttctgctcttcactctcaaagtggtccctgtttaaatgatcagtgttacggttaccctaatgttagtagaagtagaaaagagtttattttccccttctactgtttcacttacccctgaaccaggtgggggactctaaggcagcagctggagaagacccccaaatcacacaggtacccctcttccttgtgccggctgtaaagccaaggaataaaccaacccttcccattgcagggagtgggaagccagtgatgtggcttcctagtagctgtccccagcctctagactgtaccgtctggatctgcagaggcctgttcactgtcatgccttcatgcagatctctggggtaagtgctctgttgctgtaggaaaataacttacaacttttctttgaatgtatttacatgaatgcctatacctttatttaaatgcataaatgttgtcattacatgattcatgtgtatgtgtgtgtgtgtgtttgtgcagactcttagttttttttcctgttagtttgactttccttgacacctctcctctgtcctccacccataaccactagaaattcatgctaatagcctagtagggatccttccacatttttcttcatgatcatattatcctgtataaatatatacatacacacactacatgtggtagacatgtatgtacatacatgtatgtaactttttatacacacccacatgcattcacttatacacatgtgtgcacttatacatgtatagccagccttttgtcattatttgttttgcagaaatatatgatattcagtttcttgcatcttgttttcctcactcaacaataccttggggaactctctctctgtcctccaatattgctctaattgttttcaatagggcataatatcgcatggtataaatgtactataatttatgcacccagacctcaagagtgactgctcactttgttttcatgggagaaatttcccacattcaccaaatataaatgtgtgacactggccgggcgcggtggctcacgcctgtaatcccagcactttgggaggccgagacgggcggatcacgaggtcaggagatcgagaccatcctggctaacatggtgaaaccccgtctctactaaaaaaaaaaaatacaaaaattagccgggcatggtggcgtgcgcctgtagtcccagctacacgggaggctgaggcaggagaatggcgtgaacccgggaggtggagcttgcagtgagtcgagatcacgccactgcactccagcctgggcgacagagcgaaactccgtctcaaaaaaaaaaaaaaaaaaaaagtgttacacttttgccctaatgctcctgactcacatctgattcaaaagtctttaaaaacacatgtcgatttgaaaaatataatcagctgctattttttccaagatgtcacactgacccaccatcaaactgtcggcacagcttggtacacttgttccctacgcagagtcacaatcagccttttgtattctctggtgtttgttgtctgattgcaattctgaattggggtgaccatcaaaactgggtgcctacacaggaggcatctcaatgtattagagaggggccagtctttggaacagacagacctgggttcaaattctgataaccatcacctataagctgggagatttggataaatgctcaccttcccccagcccctgttttctttgtctttcagatagaaatcatgataccaaccacatagagcattaaatgagattatgggtgcacagggcctggtcccagggggcccactgcccaggtggcttttcccaaccacaaattatgaatcatgttggacttgaaggggaaaagttcaaattgatcaatagcgatgtcaggggcaaacagtccgagtcagataagcaaacagaaacaggttgtttttggaataattggatgccctgtctttgtttgcagagcagcgtgtgcaccatggatgtttaaggaagcttattgccagcaatgtccagatgactggtgagccacagcaagagaggggcctggctgcgggagggatccagaaagcagggagctgatggaggtttaggattaggacctgaggaagggatgctagggcaaggatgcgggaggtagcagtggcctgaaccctcctacactctggccacagacttgatgtggcaggagtagttgggtgggcatttttccgcctggcagcagaggtcgctttctgtcctctccccacaccatacatcacactttccaactccaccatactcaaccccctaagaagaagaaagaggaaatgagctccacaacacaggtctgttacggactgaatatgtgtgtcccctcaaaatgcatatattgaagccctaacactccagtgggatggtatttagatgtggggactttgggaagtgattagggttagatgaggtcacagggtaaggcccctatgatggaatgaatggccttataagaagaggaaggaaaagactagagagcatgcatgcgctgtcagtctctctccctccctccttgccacgggaggacacagcaagaaggtggccatctgcaagccaggaagagaggcctcaccaggacccacatcagctggcaccttgatcttggacttccagcttctagaactgtaagaaataaacgtctatggcattctgttatggaagcccaagctgactgagactgcagccctgcctttccttttagggtacccaaaatggagtcctgtggccaacacaagccgtgtgcctcatctcttgccatgttccagtagggggatatagctgtggccaagacaagtggggaggtatctggggtgctcacaggcagggcctggagaggagccctcttctgggcaacttacacaggactctgagatactcctcagcatctcccctccttggtgctaggcatggtgtcttgcacacagtgggagctttatatgtgtttggtgagacattgattaaaaataatagacagcgaatacacgcagatgtggagagagacggaaccagcagttgctagattggaggaaagagtgtattcccgcctcagccccgccctgtccacagctatgaattaatctgcggtggggagcgggattccttcattaaaatctccaaaaagggagtcatattaacagccaggcacaccgttcttttccctcaaggtaagaagattcatggctcaaacttacattttatcacgcacaaccgaataaaaatgatcaatttccctgcccgccttacagcatccttccacagttattaaagtctctaaaaatgttttccttaaaaaaaaaaggttaaaagaaagagaggtgcagagagtgcaaaccaagaagaagctgggaaatgctgcctagctgagggctatccatcttgtcagctgcagaccacataaccttgatgtcactatattttctgctcatatccaaatttacaatttgccagccaaggatatggaaatgccaaacctcccccttggaggtggatgctggaaggttcttaaagagcctgagagagaggagcatcctagctctgaaaactccaaaaagacactgagcctgctgctggactcttagcaattttccctgagttgggaaaaaccagcctccaaggtcaaggagatggatttcaactccagggccacacacacattcagcaagagcccctttgttcattgaagaacaagcaggtttccactttggagggccagaaatgtacctgtgcaagttaggaaatgggagggttgggccacgcaacaaacaaactctggtgtaaaccagagtgaaagagaagtgtttaacctacaggaaagagcaaactgcatgccagccctgcagagctccgccttgcatgcaaacacacaaatgggtaattatacatcattcatctagtgggtccccaagaacctttggtttgccattttggtaatttaattttactaagtgccaagtaatacaattgtatatcaccccatttgtgaattccttcaggacaaggataagattctctctcctctctctctctcccctacacacacacacacacacagacacacacacacggataagactctcttctctgtcccctacacacacacacacacacacacacacactaggtgctttctatagggctctatttaggtctatttagttgagaatggtgaaactatgctttaaaattccataattcggctgggcacagtggctcacgcgtgtaatcccagcactttgggaggccgaggcaggtggatcacctgaggtcaggagttcgagaacagcctgaccaacatggtgaaaccctgtctgtactaaaaatacaaaattagccgggcatggtggctcatgcctgtaatcccagctacttgggaggctgaggcaggagaattgcttgaacccaggaggcagaggttgcagtgagccgagatcacgccattgcactccagtctgggcaacaagagcaaaactctgtctcaaaaaaaaaaaaaaacaaaatccataattcacaatttgttaccaggtcagtctggtctctttccaaattagtgctcattagttaggtcttcctggacttgtttctgagtgaatctggacatctgtcctttgctcacactttgttaacactcagcacttccattctaacttctggagggttccccacattgtagatagggccctggggccctgcagcatagttggagggttgcagcctcccaggaaggccccctccatcgctctaagtttccccagcttgtgagagccttgtatccttctgggagtgttttcctgccgtggctggaagacagccatgaatctgtctcgggccatttgactcgggctcccaatgccaaccctaacagacacttccatcaggcctgacgcgtcaacgatctataagccattaaccagcgctatcagacctcccagattcagcctcctctgtgagaacaaatacagagaagggggaaggagggaggagagaagaggtatagagagagagaagaggagagaatgccaggtcctccatttcctatatggataaatgattgatgatgatgatgatgatgatgaagagagcagctaacaatgacaaagctcactgtgtttcaagtactcttctaaactcatcgtatatggtagctcatctcatcctcacaacaacccaaaaagatacgttgttattagactcactttgcaggtggggaaattgaggcagggagcttttcagagactttgtgaggtcccagcactggtgggtggcagagctgggggtttagcccagttgctgggccccagtgtttgtgctctcagccactctacgcattgcctcccacagtggtcaggaagtcagagtcaaaagagatggagagagttcagctcaaagcaggcaagagtcctagttccctgtgggcggtggctacactgtgaggactggcccccagctcaccaggcagaggagagcagctttcccagagattccctgctcgggccacagagacaaaaatcttccattccttctagaaataacagtgtctaagctgcttcctcagtcagagcccctcagaccatttgtcactccaggtccacaaccccagaggtggttcttagtggccacagcctcagctgcagctcccctcaccctggccaaataaaggggacaggtctccaaagtctcctcatgtgccaatatccccttctcacgcaggagagatgggatgggaagggatgagacggaatgagtgctggggaggagatagaagggaggggatagaacaacatgggacagggtgggatgagaggaaagggaaggaaaggcacgcaatggaatgagataggagggtacaatgggaagagggggaaaggggcagaaaaggaatgatacgcgatgagttgagaagggaaagggtggacactggctttttttttttttttttgagacagagtttcgctcttgttgcccaggctggagtgcaatggcatgatctctgctcactgcaacctccacctcccgggttcaagccattctcctgccttagcctcccgagtagctgggattacaggcgcccgccaccacgcccagctaatttttgtattattagcagagacagggtttcattatgttggccaggctggtctcaaactcctgacctcaggcaatccacccgcctcggcctcccaaagtgctgggattacaggtgtgagccaccgcgcctggccgacactctctttttaaactatccatacactcccatcacccctttttcctagaaaattacagacagtcattagaacagaaacatccctgcagccccaacatctcctgtgtagcacaatacatggcagttagtgacccactgccattggccaggattgaaaagagtccatgataggtgtaggagctcccacacccttgcaggctggctccagaggcttcttcccaagctctattcccaagctttgggccccaacctacctcctttaaggccaactaaatcctcacctcttccaagaagacttcttcaactatatccttcctttctctcactcccagctctgtttagcatttgtcacccaatttaacgcttgcttctgtacaatgttgtattgatctttaatcttgtaatccagatctatagcatatagcctgtgcttctgcctggtggcaaccctgaatgaatttaattcttccagcatttaagaagcagaatcacagaactgtggagcattaaccctcctgttacaaatgcagaaacaggctctgagaagtcaaggggcatacctggcatctcatggctggtgagccagacagctggggcacccagagctcagcatcctgactccctctgctgcagtgcggggagcttcctgccttagtcagggttttcctaaaaacaggccctccaacaaggatgggagtactggtggtttatctgggaggtggctgcaggaggcactgtgagggaggggagaagtaagaagaggaaagaggaaagctgattaaagaggtaggtttcccttgtgcatcctgggggcccaacccctccaggcctccaagaggctgcagaactcaccaggaagccagggcatttctccaggagcccttgtccctcagggttgagagccccacttagggagttaactcccagcacttctagcctgccctgcagggctgagcccccttccatggccaaagaacccataaaagcaaagagcagtggttgttgggggtacagagccttggcgtgtgcatgaattgtctaccgcagctagggtgtcctctgggtgggtcaaggaatgaagggcaggccacccacagggtatgccacgtttgggaaacacttgcccatccatgggagtagaccttggtgccccaactttctttcacatctgtttccggttctctttttgataggaacaaatctctgctccaaggtgtcagatgaaagaatggtgctccccaccctctccccaccccagggatatatatcgtcatggggactttgatggcacataaggaaaagcgcactgtctgatgacatgtggcaggtgatatttgggggtgccacacattccagccattcctcccacatgtgcaagaaaaggctgcctgacatagtagcctggctgcttctgtgggccccttcttgctgggcacctcccatttgcagagctcctaatgagggacaatgtgggtgtcaggacagataggaggatgaagcagatccctcccagccccccatgctcctcatggagggcagatgggggcctgggagctggccagcccagcaggtatgatgggtttgtgcacggggatctactcgggagcccaggagtgcccagtgcaggtggccataaagaagaaatacaagcagcagtcatcaggtgtttgacacaattcctgacatgctttccccagacagggcatgccctgagtttacaaggcaaatgcatttatcacttctgcctcatgtcccaggagccaagctcacccctcagcctggaaatctgggcctccccatgtggcttgcttccccaaaaggtgccctgtgcctagcccctgcccctctctgcacatacatgcatgcatgcgcatgcacaaatgcacgtgtgcacaaacatacgcacatatggaggcacacatggaaagcacctgaataaaagacagccagcccaaattccagccacccctctgcctgtatgtagctccgagccctgggatgcgtcatggccctcatggggccttatttttctcctctgtgtcgtgatgattctaaagaacccccagggatgctcagctccctgtccagagaagttacagtcccatggatggacagcagaggcatctgttggccctctcctccaaggaggcatagtccaccttcggacacgacctgccatggtgatagcccaggcctgccaggagaaagaagtaggtgtatgggtggttggtggcatcctgctttgccctttttgcagcagagatcaagaccttggattaggttgatctggtccagcatgggaagaatgtcaaacaccccctcactaaagtgacacaccagccagcaagccagccctttctcccaccttcaactctgcttgtatcagcagagagggtcgtgttaaaactggctttggaatggtgcctgggaagctgggaggggcagttccccagtgtctctgcctatgacactgtgcggaacagcctcaggatctgggaggcaagttctttgcagaagggctttttagcaaggccctgttctccacagtccccagatggtaggcctaaaccaaagggtttctaggaaacagaccctcatagctggccactggcctatgaagacagagctcagatgcccaaataagtggaggactcttccagggagagagcagtgaactgagcccccgagagcccaccagcatggaccaggacagcccactatgggacacaccctcccacaaggtgccattgttttgcatttgcaggatttgatttttgtttgctgagattatggagcctgcatatagttcctgatttttgcaaagcacatctcaaacttctcacctgttagcactccccagcatcgtggctgagtgggtgattatcaccataccccaggtggggaaactgaggcttcaggagtcgaagagactgagttaagggcatgcagtgagtcatcagctgccctttgcttcccacacacatttctcaccaagctctctgaggccacactgcttcctggagtcctggggcatatccactgcttttgccaaggtgggttgtggcaagcgggtcactgggaataggagacaggcgttctcaaagagtatataaaggaaagaaaagaataaaggggtgggaggggcacatgatccaaaatctcctctgcagcaagctcttgtaactgcatgtccagcggcccccccttccttgcaccttccttttttacatcaacattcaatcatcttttcccattcacttcatctcttccatctttatcttacgctgcccgtgaaaactggtgtgaaataaaaaggcaactctgcctacagatgtaatcaattgatttggcaggtagtccacagacacctaggaagaggacagccaattttcagtggacatcctcccccacttctttttcttcctctacttcctcccttccgggctctccgtccccctccttttatttttctgtctccttccttttggccttgctttgatcttcttgttattttctgctttgtatttaatggaattagaccagcctatgaattttcccccgattctttctttcttcttattttatataacagacagcagaggggaaggcgtctgtcttgcccgactctctatctctgcaccatgctgtgagagctcagtattcccaggggccttgtcaatcttcctggggaggtgggaccacgatcaccatcttgaaggatcccaaactcctgccccagataggagatgggtccataaaacaaatcctagagtggaacagctctccatcatccaggagaggagaaagtgttctatgaaggagaattgtttattttcattcattcattcacttattaagcatcactatcggccaggcactggggatatagaagtgaacaaagccgtcattgatcccgcccaagtacattgcctggtgcacagtaggtgctcaataagtagtggccactcttggttatcattcttctggaagtatctatgatagtgcaagatgtatactcatgttcaataaatgttagtttcctcacttctagagacactatctcggtacgatgtctgtttattggtctttttattgttttaacacaaaaagaatagaggggtgaaattaaaatgttccctctggcctaatctagattagaagacaatcattagatacaaacgaatgtgtaattaaaaattgtgataactgggataaagaaaaagcacagggtgatatgggaggatttcatttagaaaggggtgggggaggaatctggagcctgtatcttaaagaagcatcacataacccattggctctcaaagtggggctctctcagtcacagaagcagcagcatcaggaacttactagaaatctacattttcaggctgccccagaactactgaatcagaaactttgggcaccagcctttccaggtaactccaatattcccacaagtgtgagaactgctcatgtaagctgagactggaaggaggagttggagctggccaagtggtggggagaaagaaggctttctaggtggagaagatagcatggactggggccctgaggcaggaaagaccaccagggcaagggtatagggagggagtgtgagaatcagacctttcagtgccttagaacaactggaaagagtgtgaattttctaagtccaccgggatcccctaaggcaggggtcccagtctgtggcctgttaggaaccgggccgtatagcctaggggagtggtgggcgagtgagtgttactgcctgagctctgtctcctgttagctcagcaatgtcattagattctcataagaggctgggtgtggtggctcacgcctgtaatcccagcactttgggaggccaaggcaggtggatcacttgaggttaggagttcgagaccagccaggccaacatggcaaaaccctgtctctactaaaaatacaaaaattagccaggcgtggtggcgggtgcctgtaatcccagttacttgggaggctgaggcacaagaattgcttgaacctgggaggtggaggttgcagtaagccgagatcacaccactgcgctccagcctgggtgacagagtaagactctgtctcaaaaaaaacaaaaacaaaacccaaaaacaacaacaacaaaaacattctcatgggagcacaaatcctattacgaaccagcatgcaagggatctaggttgtgtactccttgtaagaatctaatgcctgacgatctgagatggaacagtttcatcctgagaccatcctcaccccaccccacccatggaaaaattgccttccacgaaaccagtccctggtgccataaatgttggggaccactgccctaaggggttctaagcagagaaatgaagccataggatgttgatgtcatagagtcctatcactgcccacagctggctcctagttccttccccggcctcacctgccctgttggaggggctcttctcagcccctgagaaaatggcactcttgggtggtgcaggaggtcctggtagaaggctctttcttttcattcatgcctttggatacatgatgggattttctgtcttcatattttatttttacctcttttcaaatatcagtaagtggcatcaaaacagtgggattatgggttatttttgtttcttctccacaagttcttgaattttatgaaataaaagcaaacaaaattttataaagccaatatttatcaaatattattatatgtcagtttttttttgagacttccctttttattcattcaacaaatattttttgagcaactgctgtgccctgggcattgtgcaggcatggggatagaaacggaggccaacattctgccgcgacggagcatctgtgctcatggcgggagtgagaccaacaaagtccaagagcaaaatacatctcagtgtctgcctgggaaggggagtgagccatcccaggtgggactggtcagggaaagcctgagaaggtggcggctgggaaggggagtgaggcatgccaggtggggctggttagggaaagcttgagaaggtggcagctgggcacagacttggggagaggaggcggtgggggtggggggatgaagaggtaggtaggggtgggaggctcatgagagcaggaaccccaagcgccgaggtgctgagcaagagcaggaaaggacgcagggtttagtgagagaaggaggagaggacagggaggagtggggaggagcctcgtgggctgccaggaggattttggcttttacaccgagtgacatgggagcccatgggcagggcaatgggaattctgacattctgaaagggccactgggctgcttgctgagaacagctggtgagaggggcagggcaaggagagaagggagctggcaggagaacctgctagaaaccaggtgggagcggatgggagcctgagctggagcagcgagggtgggatatggtcagatgctgaatggcctctgaactgagcgtcggcgggatctgctgctgggccagataagggatgagagaggaggcttgaggatgacctgagtgatgaaaagacagcactgccacttatgaggccagggaaggctaggggagaagccagcgtttctaggggaaggagctgctggttaattcagtgttgggcatgtgaaatttcagatgccattgtgtcgctttggatgtcccaaggagcagatgccaagacaggattggacatgggacaggcttactgggggcaaagtctgtgaaggacaaaggggaggcagcaggtgctggcagactgccatgcaggcctggcacctgtgaaaggagagggggatggaaggaggcctgagaggaagagcttccgtccacagcacagctccaagagtgttcattcagaccgatgagaggtccttgagccaaaacctcccatgggggtatccaacatcccacatgtgtgggcctgccctgacactgccccctctaaccccatcccacctgctcagctattgcctgggagaagcccacatcatgtgtggcttcagcacaccataggggtgggcccactggggcagtggtggggtgtcggtcaccatggtcccctcaacagaagttgtgagtggagcaattttacagccgccacaggctattagacacgtaagtggagatatctagtaggcagtttagatatatgagtctggagttcaatgcaaggttcaaggaagagataaaaatttaagtgtcttcagctcataaatggtatttaaaggcatgagaatgcatgagcgcgtgcacagctggcagggacaaacgctccaaggactgagtcctgaggcatgtttgcaacagtcagcaacagtggccagggaggtaggagggaaaccaggagtctgtgagctcctggaagtcaagtcaagaaaatgcttcgtggaggagggagcactacctttcagaaaactgcccatcacactggcaagcatccttataggccaggcaatttgctgaagactctgtgtgcatcaccacactccacgggtcttcttccctgttgtgggtgaggtgctgtgctgccccgatgccctgtcagggccaacacagccattccccagttgctgggagtattggctgctgatgctgaaagtcacaccccctccccagggacagcctgtacccagagacggttgacacagcttccctgccacatttgggacacctcaagtggaccatctggcttacaagctcctagggggaccagctgaagcctccgttgtagctacagagttaggtagattcctccatcagagtaaagaaccgctgactgcatgggctggaggaacagggtgctacttgctacatcttatcttaaagaatcttttggatgctttggtgagaaacaggaaactagcagactctctagccaggccattgtaggtttgacccacttcaccccctcctgacactcccacctttcccaccacttttcctcttttctgtagcacttaccacctgccaacctgcgatttaatttccttatttgttgatctattgtttattatccatcttccttctttcctacaatgtcagctctaggaaggcagggctattcatctgttttgtcccctgatgtatcccaagtgcctagaacggtgtccactgcatagcaggtgccagtatacatgcacgaaatgagttcctggacgagctgaccttcaagagttcacagcccaactctcccatttttgctgaatcccaccatcccacgtgaacagaatgagccagacctccaaacccacagaggcagcgtggggtgctgggacttaccacggctaggaggcagtctcctcacctgcaaggtgggatgccaggaatggtttgctcacaacacggtcacagggagccacctcgaagccttcctgtaacgctgatcaatgaggccaaccctatggatggaacccatagtccaagccaagtctgaggccttgtttcaggggcatccacagcacctaaagggtgctgggaggggggcgttcgttgagaacagcacacactgtactcctacaggaggagaagacagacccattttagactgacggctgctctgaaatgggggactcagtgtgagattcccgtgctagagaaaagagtctcagttattcctcgtggtaagcaggcgtggctttcgatgggaagtcctgccttccctgtttcccagccatgtgaccttggccaagtcaaaaaaaatatcctggagccttattatctgtcactacctgtcaaatgggaaatgagtgagattatgtgcctgaaaatgttttgtaaattccacagcagtggttcccagactttgagatttcatagacgagggaagtttccagtaatctggagcttacataaggattccagcgttctattttgccacctaaggacactgaaacacaagcaagcaacgaagcggtggcttgcccatcgtcactattctgtcatcaaaggcagaacacacttcatgctaaaaatggaagaaggccaaaaatctgaacaaaagatagtctttgcagcttgaaaaaaaaaaaaagtgaacttaaaggaaaaactcactgacttgtccttgattttctcatgttgccaaagacaagggaagtttctctctgggaacattgtgaaatgatgaaatgagagggctgggatggcgcacccaggcaaacaagagaagctgcccaccgtggaggcggggacccggagcttcaggctctccggggctgaggggggtcaaagtctccacccacctgacacccatttgaagcatgctggtgcacaaaggtactgcaggtgggaagctttctgtagggttccctgaggaggacggagtaaagggcttctcttcacaggaggagtgagctgggagtcagggcctggttagcaggaacacaacgtacatgtgatcaatcctgagtgctgagcactgtgcgaagggcttcctgaaggttataggaaggaactattatcattcgttttgcagcttgggaaactgaggcacacagatgtttccattgcttccccaaatctcacagctagtcagtggcagagccggggccctaattcagccagtctcgttgcagaggaagtgtgtttaaccactcactccaaagcatgatctccagagcgaggaaagggcttctctgctgatgcaaagaggcagatttctagcagaatcagccctgatcctgatgctcacaggctggcatgttgggtccaagacggcaaagctacttttctgtatgagttccccattgtaatgggttgaacagtgacctccataaaggtgtgtccaagtcccaaatccctggaatctgtaaagggaacctcactgaccttatgtggggacagggttttgcacaggtaattaaagatcttgagatgagggacgggcgcgatggctcaggcctgtaatcccagcactttgggaggccgaggcgggcggattacttgagtcgacgagttcgagaccagcctgggcaacatggtgaaacccccatcactacaaagaatacaacaattagccgtggtggtgtgtgcctgtggtcccagctactcaggaggctgagaggggaggatcacttgaaccagggaggcagaggctgcagcgagccaagatcacaccactgcactccagcctgggtgacagagccagaccctgtctccaaaaacaaacaaacaaaaatcttgagacgagatcatcgttgacttagggtaggccctaaacccacggaagggtgttcttataccagacagaaaaggaacagacacagagacacagaagagaaagccacaggaggaaagaggactctgtgcctcagtttcccaatctgcaaaacgaatgataatagttccttcctataaccttcaggaagccctttgcacagtgctcagccttcaggattgatcccatggatgttgtgttcctgctaaccaggccctgactcccagctcactcctcctgtgaagagaagccacaagaagacagaggcagggactggagggatgcgagtctgggagccacgccacgccaaggactgtgcagcccccaagctgggagagagccctggaaaggatcctcctgcaaagcctcccttagaaagcaactctgctgacaactcgaatttcgactctggcctcctgaattgtggagaaatacatttctgttgttttaagccaccagtttgtggtagtttttaaaagcagtcccaggaaactcacacatcccctttcctacttcctccgcgccagcttccaaacctctcccccatgagaggatcagagaattcctcccagccctccagcagtgagctgctcccccactccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctccaccctccttgctctgtccgcgtggacgcagcccccggttcagacactagcgggtgcgcggggccgcccaggacggcgggagaggacggggccctccctcccctctggtcccccaaagctccccggacgccgcggccgcgccccctgccggctccctccggccggctcccgcgtcccactggggctcctctcccgctgcaaggtcagcgcttccccgccccacgccctccacaactccccgcccttccgttcctgctgccgccgccctctccacccaggctcctgtcacccaccacgggagttcacacgctccagtccatcggcctcccccggcccgaccgccctggctcaggcaaatcccagcctgcacttcccgaaggaagtcccctccacgcacacaccctacacgcacgcacacatttacacacacgccctcacacatttacacacacgccctcacacacgcaaatgcagacaccccctacactcacccttacacacacaccctcacacattcaaacaccctcacacacatacaccctcacacacattcacacaccctcacacgcacacagaaacgcagacccccccccctccactcacaggtactcacgctcacacaccctcacacgcgctcacacacacacttacacgtagacacattcatatacactctcttacacacattcacacaccccccccacaccctcacgtatttacaccctcacacacacattcccacatgcccatgcccacacactcacattcacacaccctaacacacaatcacagacacacacacacaaacacacaatcacatatacacatacacacagacacacacagaatcataaacatacacacagagacacacagaatcacatatacacacacatacacacacagaatcacatatacacagacacacaatcacatatacacggaatcacatatacacacagacacacaatcacatatacacagagatacacaatcacagagacacataatcacatatgcacgcagaatcacatatacacacacagacacacacagaatcacatatacacacacaatcacatacacacagacacaatcatacacacgcagagacacacagaatcacatacacatatacacagagacacacacatatacacatacagaacacacagaatcacatatatacatacagacacacagaatcacatacacacagagacacacagaatcacataaacacagacacacacaatcacatatacacacacacagaatcacatatacatatacacacagagacgcacaggcacacattcatgcacacattcacacagattcattcacacacagacacaccccctcacacaagatcacaccacacgcatgctcattcacacacaacaccaacacccacattcattcacagactcacaaaacttacacacatatacgcacacaccattcacacactcatgcaagataccttacaaatacacagacacacgcagacacaaatacacacatagacccctcacagatgcacacaccaatgcacacaggtacactcatttgcacaccacacacccacttacacaccaatacacatactggcacactcatacacagacctataaacacacagacccacccatactcagacatactcatttgcatacccactcagcaacacagactcacattcacatacatgacagagacaaactcacacaggcacactcacattcacacaggcacattcacacacaccctattatgcacattctcacaacagacatgcttacacacattcacacagtcacacacacacacacacacacacacaatctcgtactgaagcccaggcagtgtctaccagctacacagacattgtggacagtggagtggtgagaggtacaggcgtattcaggtcaggcaggtgggatctgagcagaggcatcatgagcccaagggcaccttggtggcaaggacatcacctattgtttctctgcatcttccccctccccgcccaaatcatgcagcacagtgcagggcacacaggttcatcataagtgtttcttcaatgagcagacaggagctacccaagcttcaatgtacgtaagaatgcatagtggccgccattttacaggttgaacttggagcttcaaagcagccttggataaaaccactgggccattctccaaaaaagagaatggagaatgtcaacgtccttaattgtctgcctgtattccatgtacttcctgacttagagccttgattgacaaaatccccgttccaagaaaatctccctgcatcaccgcaggcactgtgtgtttggcaagtagactttcaactttgggttgtggcatgaataaataaatgactaaatcagcaagcagttttccctgcaccttggcacaggtctgggtacaatcaaggcatcagtcaagatgggagggtagtgggtgggtgtggcctttaaaagatgggagttctgcctcagctcactacttagcccggcacagtggctcatgcctgtaatccgagcactttgggaggctgaggtgggagaataattgagcccctccagtcaaggttgcagtgagccatgatagaacaagatgttgtcaaaaaaaaaaaaaaaaaaaaaaagaaaggaagaaaagaagaaaagacagaaaagaaggaagggacgggaaggggaggggagatccgaaaagcaaaaactaaaaacctcacttctaaggcactttctggaatcgttccactccactcggatctccctctttattgggcatcgttttggtgagtaatgaattcaacctgagccccattcctgtgggaggttagccatttcactttcctagatgtgtgagtatgtgtgaacctatcgccatcacctcttctcccattagtctgtaattccccctgagcagatcgggctgtttccattgagatttctttggcaatgatgacacaactctgccagcagcaagtgtccagccagacacctgggtcaccccctagttggacggtgctgggggaagctctggcatgggcagctccacctcggatgcttcctggagtagatgttctggctggtgtccatggagatggaatgggagagggacttccttagccacagccacgcatgtcttcccctttatgggaaagtatctgagtgctggtcattttcagaccctagggaagtatctaattgccctcctggagagcccctacttatagagaagatggcaaggctgtcagagaatccaatgccacatttcccaaaaaaaggaggaaaggcgggccccaagagggccctcagcaggtacagaattggaactgccagacagacacgccttttcccatgctacaaccttggctgccatgcccctactccccttactcctgcttctagaagaaaaggaagggagaaaaatgcaggaattttccagaaagatccagaaactcccccaaattgccagaagtctccaggcttgtatattaatgcagtggtgcagtgcagtaatttactctaactacctgggtgtgcccttgattctggctagattagattgaatcaacaaagaagcagcacagagtcctccagtgctggagctgagaaaccccagagaatgcaaggaggcttcatttcctgattttctcatctgtacaatggggtggtaatagcacccacatcacagattgctgtgaggactcagtgactcagaccatataaaacgcttggcatggtaccttccacatagcaagtgctgcataaaggctgatgatgatgaggccgatgatgaaggcaaagaaactactccttgcccaaggtcatctgggcgacttagtgacagagctgcaattagaacaggggtctctccaagttaggccacgctggatagccttgctgccagttcctggtgcttttgtatcttcacgcctccccccaggcccagctgagcaccatcagggcctcaacagaaccaacagtgccccctgcaggccttggcctcctgggactgttcaattcagggctgaggcctctgggagcagtgggaacgtttgcctacaaaacaggttctgtggaatgctgctgggacactagggttttgcctccgaagatggcttccctggagtcaacagttgcctgtcttcttcccgcctcactcctcctcttgccaatcttcttagcacccaggattaagcataaacatgggagtaggggacacgagacccaggttccaggacacttaagccactggctggctccgtggctgcaggcaattcccctgacagtcctaggcctctttcctagaggccttccaacgtcccagacagctgccaagtccaaggataccctgagctcctctaagctctggccagcaggagttcaggacgtaccttgctgcagtgtggggtgatttgggcgccccagcagcttattcagagggtgcaacatcaagttcatttcctccttcctcgttcctgccagcccagcccagcccagcccagcccagctcagcccagctcagcgctgggccctccacctctgcttcccctccaccacctgtctagggcagtgtggtccagggtagctgcaggcccacgtaccagcacacattgccgcctgtctgggctctcctgctgtgtgtgctgcttggggaagagtgggatccacccatccatttttatccagcacttcgcggggtcacattatgtgtggagtgtgtgatgaagccttccaatgatgcctcctgacagagccaaatctgacttccataatggcctgagaaaaggtcatagcctgggactctgtattactctgtcacagaaattaaaggagcagtttgccacaataaaggaccgtctgcttggtggcctgctcacccttgccggcttcctcctgctatcttttctgataatgtggataagaatctgcttgcaatggcaggcaggattaattcactctccagcactacagagaagccgctgagtacagctgcctccgccacctccctggggacacacctcaggatgaaaatcacagctgggggtgcagggagggagccgtactgaagagtttatgttgaccaacttctttcctagggtttatctctttatttgccccaccctgatccaaaaagtacacaagaagaaaaaaacccgggtgctaacaatgtgctagtttttttcagtggttatttgtgggagagggcatgggaaaagagctgagtggggttagggatgtgagttttcaattattaatttgtacatatattttaaagttttgaataatttttaaagtttttgaattttccaaatgaacaaaaccaagcaccttccctgggagatggtaaatgcatgtgttgaaatgcctgcatcgcatctatatgcaagctcaggtgaaggtgggtaagcaaggatgccgctgagcccgacaggtgtggggtttgctggggggtggagaggaaggacaaacccctggaagagtgagatgaccattcgcagctcccagcatcacttaagacttgatattagataacttggtcagattaaatagaaaacatttctcaccagcatcctaaatctctcttagttttgatatttacttatgatgcttgtttttattttatttttttcttgaaagggtttacaggctccacacccccagtctctgtgcatggctttgaattttacaaatggaggctgtagcctggggaagacagtgctgcttccatcgtgagctgcgctgtggctgtctccttcccatctgcaggaattgaggaattcctaagatgacttgtttgggggctgctttgctgctgggggtggggaaagacaactttctggcagtggctcttgagtgaaccaaaattgccatggataacaaatgatgcaatactaggtcctgagcaaggaaaaggcataaaccccggaattggagaaagctgcttctaacataactgactcctctcagttcttgagagtaagaaccacagagcagaaaaagtgctgggtgcctcagctctgcagcctggtccaggcgaccagctcccactcctgctcctgacagagttgaggaagaaaagatccagctctgctgaagataggtcaccttgaggaagagtcggttcaaaactttgtcagaagaagcctggaaaactgtcaaagaacctcacatccctgacaccagtgaatcttgactcctcacatgacagcaaagcccaggagggaggcattttcagacaattcttggcaagacgcctccggatattacagtccttgcaggtgtatacaaacagccaggagggtcagaagacaccaatgctggcggcttcgggcttcactcgaaggacatttctctgatcatttccaacaaggccctgagccaaagtatgtgaaatcctccgcatttttttctttcacttttttactataagaaaggacaaatatgtacaaataaacagaagagtgtgatgaatccccatgaacccatcacgaagcttcaacaattatcaacattgttttgtcattctggtttcatctatccctcctactcaacacctctacactagattattgggttttattttgcagttttttagataagatttatatacattgaaatgcacaaaaatcttccctctacaagtttgacaaatggatacggccatgtaacccaactccccactacaatataggacattgatggggtttgggtgtttgtcccctccaaatctcatgttgaaatgtgatttccaatgttggaggtgggccttgtggtaggtattggatcatagggtagatccctcacgaatggcttagcactacctccttggtgataagtgagcttttactctgagttcacaagagatctggttgtttaaaagtgtgtggtacctccccccattgctctctcttgttcctgttctcaccatgtggtacactggctctactttcaccttctaccgtaattgaaaacttcctgaagtctttgcaagaagcagatggtggtgcaatgctttgtatgcaacctgcagaaccatgagccaatgaaacttctttctttataaatttctcagcctcagatatttctttatagcaacacaaaaatagcctactacacaaaattggtgcctaggagtggagtgttgctatacagatacctgaaaatgtggacacagctttggaactgggtaacaggcaaggttggaagagtttggagggcccagaagaagacagaaagatgagggaaagctttgaacttcttagagacttgttaagtgactatgaccaaaatactgagggaatatggacggtgaaggccaggctgacaaagtctcagatggaaatgaggaacagattgggaactggagtgagggtcacctgtgttaagccctagcaaagagcttggctgcatggtatccaggtcatagggatctgtgaaagttgaacttaagagtgatgatttagggtatctggtggaagaaatttctaagtagcaaagcattcaagaagtagtgtggttgcttctaacaacctactatcagattcaggacaaaggaatgacttaaagttggaactttaagttccaacttaaaagggaagcagagtgtaaaagattggaaaatttgtggcctggccatgtgattgggagtgggggaaaagcattttcaggagataaaacaagcaggctgcagagcaaccacttgctagagagattctcatgagtaaaagggaaccaagtgctagtatccaagacaatgaggaaaaggccttgaaggcatttcagagatcctctaggcagcccctgccatcacaggcccagaggcctaagaggaaagaatgtttgcaggagcaaggcctggggccccattgtgctgctcaacctcaggacactgctccctgcatcacagctgctccagcctcagctcaaaggggcccaggtacagctctggccaccactctagagggtgcaagccataagccttggtgggttccacatggtgttgaacttgcaggtgctcagaatgcaagcataaagaaggcttggtggcttctatttagatttcagagcatgtatggaaaagcctgggtgcctggcagaagctgccacaggggcaaagcccccacagagaaactctactagggaaatgcaaaggggaaatgtggggttggaactcccacacagttcactgcctaatgaagctgtgggaagggggccaccaccctctagatcccagaatggtagagccactggaagcttacatcctcagcttggaaaagccacaggagctcaactccaacccatgacagcagccatggggactgcaccctggaaagccccaggggcagagatgcccaaggccttgggagcccaccctttgcaccactgtgccctgaacgtggaatgtcatttcaagattttagagctttgagatttaatgactgccctattgggtttcagacttgttgcccctttctcttggtagatttatcccttttggaatgggaatgtatacccgatgcctgcaccaccattgtttcttgggagtaaataacttgtttttgatctcaggtttgtaggtggaaagatgagactttggactttagacttttgacttgggactgttaatactggaatgagttaagattttggaggattattgcaaagtcatgactgtattttgaaacgtgagaagaacatgagatttgggggatcagaggcagaatgatatggtttgggtgtttgtcctctccaaatttcatgttgaaacatgattcccagtgttggagatggggcctattaggaggtgattggatcatggtggtagatccctcatgaatggctttgcaccatccctttggtgataagtgagttctcaatctgagtttgcaagagatctggttgtttaaaagcatatagcacttttcctcttgctgtctcttactctctctcacaccatatgatatgccagctccaccttcactttccaccatgattgtaaacttcctgaagccctcaccagaagcagatgctggggccatgcctcatgtacaggttgcagaactatgagccaattaaacctcttttctttataaattacccagcctcaggtatttctttatggcaatgcaaaaatggcctaatatagacattttcatcttattagaataatctatagtgtttcttccctgtcaatatcccccacctttgtcaggcaaccactactcaaattttttttcaccatagatttgttgtactggttctaaaaatgtatataaataaaaccatatggtatatacagttttatgtctggattaattctatctgcttaactacagtaagattattccatgttgttgcatgaaccactagttccttttttgttgctcagcagttttcccttgtaggtttattccacacttgtgtatctactcttctgttgaaggacatttgcactcttcccaatttgggttattattaataggattgtaatgaataattacacataggactttttggacgtatgttttccttgctcttggataaacacctagaagtagatttactgggtcaaaagataggtacatgattaactttatgagaaattgccaaaactttcttgaaagtggctataacattttgcactcccacaaagcacataagacttctagttgcttcacatccttgtcaacatttcttgttgaaagtctttccactttagactttccagtaggtgtgactatgtagtatatctttttatggctttaatttgcatgtacttgataatgaatacaatgttgagctcttttatatgtgcttattgtccattcataaatcttctttggtaaggtgtctcttaaaatcctttcaccattttctagcgagttgattttcttttcattattgacttttagatgttgattttgtattctaaatataaatcctttatcagatacatattttgtgaatgttttctcccagtttgtggcttgctattttcttaattgtgtcttttgatgagaagtttttaattttaagaatttatccattttcttctcttacagttattattttctgtgtcttgtaaaaaaacaacaacaacaacaaaaaacttttcttaccctagattacaaagatattctttttttcctaaaagcttttaaatgttagctttaatgtttgggtctatcattcatcttatattaattattgtatgttgtgtgagataaaggttgaaattctcttttattctcccatgtagacaccaagttgttctaacagcgcttgttaaaagacttttctttatccatgtaaatgttttagtcccactgtcaaaaatcaattgatcatgtaaatctctttctggcctattcttttttattgaccagtttgtctactattatactgttttaattactttacagtgagtcttaagtttagaaagtataagtttcctagcattgatcttctttttcaagactggttggttattctaggtcttctgtttttccttatgaattttaaaagcatattatcaatttctattttataaaagtctggaggagttttgattgggattgaattgaaatataattggggagaatttacatcttaacaatattgagtcatctaattcttgaacatggtatgtctctccatttattacagagataattattatagaaatacaaaaatacattatggaaattattacagaacctgtcatttgtctcaatagtattttgtagttttatgtatacagaccttgcagaccttttgataaatttatttctgctatgaggctaggagcagtggctcatgcctgtaatcccagcactttgggaggctgaggcaggcagatcagctgaggtcaggagtttgagaccagcctggccaacatgatgaaaccccgtctctactaaaaatacaaaagttagccagccatggtgatgcacacctgtagtctcagctacttgggaggctgaggtgggaggatcacttgatcctgggaggcagagattccagtgagctgagattatgccgctgcacttcagcctgagcaacagagtgagactccaactaaaaaaaaaaaaaaaaaaaaaaatgtatttctgctatggactgaactgtgttccctaaaacttctcatgttgaaaccttaactctcaatgtgattgtattttgagatagggctgagatataggaggtaattaaggttaaatgaggtcataagagtagggtcctaatctgataggattggtggcttaaaagaagaggaagagagttcattctctctctccatgagcacaaacctagacaaggccatgtgagaacacaatgagaagatgaccacctgaaagccaggaggaaagccctcaccagaaccccaccatgctggcaccctgacctcagacttccaccctccagaactgttagaaaataaatttctgttggttaagttgcccagtctgcagtattttgttatggtagcctgagcagattattttgtttttattttttgagagacaatttagctgggtgtagaattctgggtagtaggttcttttcttttcctttcagcactttaaagttattgttcccctatcttcaacctcctttgtctctgatgagatgtcaggcaccattagtatcttgtaattgaatgtggtggtgtttttctctgttttcaagagttgttcctttgtcttcagattttagctatttgattatgacgggcctagatgtggtccactttgtatttattctacttgggattcattgagctttttggatctataaattcatcactagattttggggattttcagtcattatttctacaaatatttttctgcctgattttctgtcccctctccttctagtactccaattacacatattttagcttgatattttccacatatttatgaggttctgtgcatttctattactttctttctctgtatttttccactggatactttctattgacctaccttcaaggtcactgactctttcttcttccatttccaatctactactgaatgattcaagggattcttttatttcagttatatacattttaagtgtaaaactgtactgcccaataatgtaatcactgtgtgccttttaaaattctaattaatttttggttcattcacagcagctacatttcaggtgctcaagagccacatgaggctagtgactattgtgttagacagtgctgatatagaacagttccattgctgcaaaagttctttgaacagcattactctagaatttccatttggctctctatgataatttctatttctttactgtgatttctcattttgtatgtattttccatatgtatatattttaagtctttgagcatatttataatagctgttttcaattccttatctactaattgcaacatttggatcatcctggggttgatttctactgatgggattttttttttttggtagaggcaacattttcctatttatgtgtctagtgatttctgattggatactaaacattttttttaaatacactgtaaagactctgaagtctgttttgtttttctgtcaatttattcagtcatgcaagccaattgagtatctcaatctccaaaaatcatctcccccttgaccagtagcaactaaaatctccaccagtttcttccacttccagttgcttttttttttcctgatccttatcattattattagaccaatatcattatcaaatccacccaaaaaattgtcaagtctcttctcaatatacatatcttagatgtgccaagaatttgggtgaatctcatatgtattttgggctctcctcctttgaggcacacttccttcaagtatttccttcttaactttttttttttttttttttgacacagagtcttgctctgtcacccaggctggagtgcagtggcatgatctcagctcactgcaaccttctgcgcctcctgggttcaagcgattctgtgcctcagcctcccaagtagctgggattacaggcgcccaccaccatgcctggctaatttttgtatttttagtagtgatggggtttcaccatgttggccaggctggtcttgaactcctgacctcaggtgatccatccaccttggcctcctaaagtgctgggattacaggagtaagctactgcacccggccaactttctttcttcctgtccggaatgctgtcctctgatacctcaagccaatacagttgtagctttctaccacctcaatttatgcacagatttgggagttccaggcaaaacgcttccaactcacaaatatcattcatgcggtctcacaagggcagactcacctctggtttctgcctacttttgggtattcctctgtgctgttttgtgttttgctcagagtttataattgtcatctgtggaagacttactgtgaccaaattactacactactaccagaaggcagtagctcccaccttgtgtttttattttttatagtaaactgaaatagtcactcagtttgtgttgctgaagactattaacattaaggcatatcatcttaggaggagaagcttcttgatagcatagaggaaacgcaaagcctggcctcataccattagctgtcagagtccaaagtcatcagtacctctaggttacagttgtcagtgattactaaggaacacagactatgtaagaggaaaatatcacagtcctaacttgacctaacctttccttcaattaccttcaatccctagaaacaacttttgctttctcttccatggaaagaaatgttagagcttgagaatcgaatcagcattgttatcatacccacccccattgttatacccaccccccaaaattctccttaaaccacctccttaaatgcatagatcatgctcatacagaagcctaacagttcagtagtaatcggatgatagatgtgcatgcgggtgctcagaaggcatattgcatatggcagggggtagggaacccagtcttgccatttttttagctgtgtggtcttgagaattttttttaactgctctaagccacagttttctcatctgtaaatttgggataatagtatctattttgtagggttgttaagaaagttaaatttttaaagtatagaaagtacctatcatactgttgctaacagaagactctcaagaattctgtttcctcccctgcttccttaagatctgtatacaatgcacttgaggtctctaccattaaccacttgaaattccagttggaggaaaagtcttaccagcaaaaagaaattccccaaatttatccacatcagtaatagttgtctagatacttgtcactcacccagagtgaccctgaacatggcatcttcagttcagaatttctgaggactgcttcaatttcctacagtttcatggaaactatacttcataggattcctggtgcaagaccacttttcaatgcagtcctccaatttacaggatcatccaagaaataagtccctttaaatcatctagtatccagatgagaaaacctgtgacatcataacttccatcgtcacttccttaggctaatgaattaatgctgtttgcattcacctgtcctaagatgaaattcatgcaaacctgattgcattgcccccaaaactggacaaaagcttccaacctgcccagggcttttcattcattttatcttccataaaaggcaaccatcgttgaaccactttagtgcccactgagaaaagaccttccaaggtgttggatctaccagtgaacatctgcttctcagaatgtcaagcagttattgactttttgctttgtgcgagcacattgcaatgttctgtttcttatcatgggcacttcgcctaaagtgttggagccgtgcttatccacaaaatgagaggtggccctgaggctctaattacttaccactgaagaacaatgtcatcgcaggaggaacaacccacaaactgtctgcacaggagtccagctgctccccaactatctgtgcaagcctgtccctacaaactacctgcacaaggctatgggggatttatttctaatgatgaaccagtccccgggacccatgaaggagacttgcctttagtgcttagaactaaaaatcagatgtttgccagtgagtgcagacaggcagtactgaatccttccctgaaatgcctccctgctcattgcagattaggttgagccaccctcatattaagttatcacttggattcattcactcattcgatgcttattgagggtctacctgtataaagacagcagtgaacaaaatagccactggccctgcctggagtagcttatattatagtgcagtgagacagataataaacaaatggataaatataatatcatgtagtgataagtgctgaggaagaaaataacagagaagccgaagacaggtgcagtgcctcaggcctatagtcctagctgaggcaggaagatcccttgagcccaagagctcaaggctgcaggtgagctaggattgcaccactgcactccagcctgggcaacagagtgagaccctgtctctaaaaataaagagagaaagtaaagaaaataatagagtaggatcaaaggctagaaagtgagggagtcaaggagttatttattgcagagtgcttaagaaacccttcccagtaagatagtatttgagcagagacctgaagaccatgcacacaccttagagaagtgtgtctggtggaggctgcagtaagggcaaatgtctgcagcaggagcatccttgttgaatttgaggaatgacaaggggaaaatgaggcaggagcagagagagcaggaggcagggaggcaggaagtgagcccaagaagttgaatgaggccaaatcctgtagggcccctccttcagctgatgccgaggcaatagcagcaacttcctagcaggcatcctggcttccagtcttgcttgcctccaacccattttccgcacaggtactggagtgagctccctgatgtaaccaggttgccttcctatgtaacaccctcaaatgcttccattccattgagtgcaggatcaagctcaagctccttaagctgtaccacaagggcttccttgaaactggcgccccctccagcctctcttctctgtaatttatgccccagcacaaccaagctgcctgaacttgccccactgcatggagctccttcctctcccagccatcactcacgggcctcctctgtctggaaggcacacaccaaattgattcagccagtgactcaagagtcaggaccatagaggccattcaaggtcagttactgggtgaacaaggagaaatctatcccaggcactgataataggcataaccaagaatcagctctaaggatgctattaggatccaaaaccaaggtaagaagaggcagatgctcacactgcaggaactggttaattccatcaggggatgtttcttaggacaggaacaacaagtgttgactgagtgcaggcttctcatagaagacccactacacatcacaagacatacaaaacactgtatgtatgtgttttctctaatcctcacagcacaaattatacagatgagataaatgaggttgcccaaatcctaagaagcagagctgggatccaaaccccagcaaatgcgattccacagtccatactctcatgccttccagagccgggtagggaggcaacagcagcatcaaagattgaagggtccagtggccgtgccctccatggaaccagagccacccacacacatgcatgcactcgaagaggcagctacagggaagggactgaaaacaagccttggtaccacctgcctgtgctcagttcctgggtctacatgggttagctcatggcctctctgtgcctcagttgactcagctgtaaaaacgaggcaattattactggcacataggattagaagagttaattcctgtagagcacttacacaatgtctggtgcatgttaagtgctcaattaatgttagctacactagcaagacatggcaaagtcacacgaaagtcctcttccggtccaccctgctggtccgagatcactagcacagtggtggcaagaagtggcctgaatttcagagagcacagggtcaatatttaccagaatttgcctttattctgcactggcccgaagaggtgttttctggggagtcaacccaccgctttgtgcaaccctagagtgtgtctttgtgaggaggcttcaccctgccccactcctttcctgctgctcattttcatgttcagagatggccacagcggtcactgctagtttagttcacttcctcttcattgtaaactccaagtcccaaacctaccagccctcactctcctgagccgctcagcagcccagctgatttcatcacagccataactctctagaatagctgccgttacgcaacagctcctagcgcaaaactggtacgactgtgtctactgcaatgtattcatcagtttccacaggcatttatttagtgcctactgtgtgtgtgtcatatagatgcctactgagcagtctccctccaccatgcacccccaccatcactgcagacacgcttcattgtcatccctgagtgggagccatctctttagagagggtatgagatgttttgcccgagtttgagatagtcctctcctggtgcccctctgttccgtcctctcatcccacgtcacctgcttgggctcctctctggctctagctcctgcagggtgtctcttttgcctgggtaggagacgtcctctccctcctgatgcagcctctgctgtctctccaacagtctgtgctcagcctggagatcacccccaaaggggtctgctccctcgtctcatgcctacttaactgatctgcctccagccatcaccgtctcgggtcttcatgtccctgatgctctgtagccaccaagaacatgtcctgcttcataatctcctgttgttttttaagcattccctgtcaccactcccatccctatctgttgggtatttctgcatctctgagtttcctttttttttgagacggcgtgtcactctggtgcccaggctggagtgcaatggcacgatctcggctcactgcaacctccacctcccgggttcaggtgattctcctccctcagccttctgagtaactgggactacaggcatgccaccagtcctggcaatttttgtatttttagtagagatggggtttcaccatgttggccaggctggtctcaaactcctgacctcaagtgatctgcccaccttggcctcccaaagtgctgggattacaggcatgagccactgcacccggctttccttctctcttgaacactgagttctcagccatctgtccattcataaatcttgctaccctcctcgccactgcccatccagaagtctaccaaacaattctaagaacaagtattttcacatccaactccacatttccttccacggcagctccagactctcagacaggtggcctttgaaccccagattcatgggtatttacagacaggtatcaactccaccatgaatctagagtcttgaaaatgaaaaagaaatttcaaattgtgcctctgctttcaactagtatcacatttccgctttgcaagaaacagcaagtgcagcgtgggtgaccagatagtgacctgtcattccacactcctcctgcaatgtccatcaagctggcttcaagtgagtctgcatatcatctttgctactgtgaagatgccacagagctcttgagggtacacaataggcattcagccacactcctgcgcacatgggtgcctacaacttccccatccttgtctcaggcttatttttctgtggtattaaaggatcacaaagaatttctaagtcagtcgagttctttgttgctatcattagttgtagtgcatggagggggtaaacaatgcagcttgttcttttgcctctccagttccagagatttatttactagaatttttttttttttttgccattgagttggaagaaatcaagaaagactaattactttcttttttagctgagcctaaagctggatacaagggtaaacctgggagatttacatctgagtggcggttttatgtctcagcctggaggcggtagttgaacccactgtgtctttgcatttgtttttggaaaactgtgagcatcacccccagcatggatgcctgagtggcaaccaagaccctaatctatagcatggggtccccatctggacaatgatgcaccaatgagtgccgagtagaagtggatcctatcctcctatgctcctcaggataggccaccctgtgctgtgaaaacagaccacaagaaaccccaaaagctaagtaaatgccatgatgatcttgctcatggatgctctgctcattgcagtgacttcaatggctacgagagacgctgtctcagccagggtaaggggatgcagtgactcacattggctcacagagtagacacagccgtgcctacttccagggctggggagtgtgtcctgccacgtgcccacagcgggggccaccgcgctgatgatcactgcaacttgcactcctttgaagctctggggctgctcccgcatctgcgacagtcagcatagcccctgaccacaccctttctgcactttgggttcatgggttcatgggttccatttcgttccccaacagcagtttggaaaacttctcatatatttctccaggtcacaccaacacaggagtgaaaacggagtttcatcagttgagaaggaaagaggaggggaaggaagggcaggacaggggaggggaggagaggggagacctcaagctcatgcaggtacaagggaggtgtcccctgtacactagtcccatgtcactcgccggtggctcctggtctggctgcagctgctctaccttgccatccaggtgctctgccttctctggaactttgccctgtcgtcctcagacaccagctgtaccccatcacccttgcattacatgctggtacgtgggccacagagcaatatgagcttctgtatttgtatccttgcctgacagaagttcccagaacagctggtgtgttcctgtgtctgtcattaccttctccacaccccaggacagagagacggcaacaacgtaaaaaacactccccaccatactaagtgacccctcccctcgggccctgcacctgtgcccaagaaccaactctacactccgactccttttctcaggatgggttggtctgtttattttgcccataagcctcctgcattcctcccgcacgtctcctcctggctggacctctcctgaatcccagggcagacagaggttagggtcttaaacagcccccagcatgcccataagcaatgtcagagaagccacgaggtgtctactgcaatgacaaggaagacattgttcactgcttcaatcaccggagaagacaaattccccacacagtagagcctgtctgtgcacagtgggctgaaacagacacttctcccctccagagtgctgcagaggggcctcctgcattaggagaaaagttgggccaggtgacctcctagtccttccagctctgagattcagccatgttcctcccagcagggactgattgtatttgcttcacccttgggagccagcagggtttggagcatagagaagagtgcacacacccagcgccctggctccaatcgccccagctctgtccctgacacagccttcccagctttgggggaagtcctcaggggtgcgacagggcccggactagagtgaagcaagtccggccctcagtccaggcagaaaatttagggggaccccagaaactcactaaacaagataatatttattgcggcattcttaggaaaccaacatgaaataaaaactatccacaacgaacaaaatatccaaatgtggactaaagacaggccttgtccctgtacttggacaacccacaccctagtcccagcccggccagatcctgtctttatttcacatgtggacagcagacagtttgctcatcacagattttctctgcttcgactatgtgtgatggtcttgactcctgagtatttggctgccccttttaaacgtggctgcaggcaagtgcctcgctctccccatcctggcctgggtcccgcccccccccaggcctctggagctgccctgcgctatttgctctccctctcctgtcggcttgggccgccttcatctctcatggagttccgggcaggggaccacccctgtagtagacactgtcggtgccccagctactcagccttggccttgacggttccaacgcccgtggcttctgactgcaaacacccatgactcagtctgggagctttcacaggagccaggagcatgttcacagcccacatctggggaagccggatctgccagagaattaacccctatggatgttaaaacatctcagctcctcacccctcaggagggatgatttggaatgatgtggtgcacctggccctgaggcctgtgaagggatccaggtgcaggatgtgggcctggaacacacccagagccagctgctccccttccacgctcatttcctagtcccttatcagtgcttcctgggatcacctccccagacaactgcttctggggccatctggctgagacaaaccagctgccattgccacctagggccacccatgccctgtctactgatggcccccagagcctcacaatgccaatgccacctggctgaagcccctttgctaatgcggtcaggtgggacaaggggacaatcccctctcccatccatcccatgtccctttggcccacagacggttctggtgagtgcaggaagcatcccattgcatccccagcaccaggcagggggtcttgtatgacaaacacccttcctttccactctagtccttctgtggcaggcaggtctcacagatgcaggcttccataacaactgtttcagtactgactgagtggctaagctaaatattaaaagccagcacccttacacaaaggctggaatgtaacaaaggcccaccaggagttttgcctaggcctttcctgggccttaaagcatgacaagataacaaaggaattcttaacaggacccatttaggattaaacaagttttactgggggtctgaagaaacttgccaaaccactgtgacttagcccgagacaagataagggtaatcaccccagcacctggacccattttagatcaagtaaatttactgaggcttcagaggaaggtcttcaggactcaggccttaggtatagattaaaataagttaatcgcttatgtcttttctttttttttttttttttttttcctgagatgaagtttcgctcttatcatcacccaggctggagtgcaatggtgtgatctcagctcactgcaacctctgcctcctgggttcaagcaattctcctgcctcagcctcctgagtagctaagattacaggtgcctgccaccatgtgtggctaatttttgtatttttagtagagacaggggttttaccaggttggccaggctggtctcgaactcctgatctcaggtgatctgcctgcctcggcctcccaaagtactgcaggcatgaaccactgcacccagccaacttacgtcttttttttttttttctttttttttttttgagacggagtcttgctctgtcacccaggctggagtacagtggcacgatctcagctcacttcaacctccgcctcccgggttcatgccattctcctgccttagcctcccaagtagctggaactacaggcacccgccacaacgcctaattttttttttttggagagatgggggggtttcaccgcgttagccaggatggtttcgatctcctgacctcgtgatccgcccgcctcggcttcccaaagtgctgggattacaggcgtgagccaccgcacccagcccaacttatgtctttagatgaatgtacacttatacttagatacatagcttagaaagtatgtaagctctagaaaactttgtaattttgagttcgtctggcaatattttccaggtcttttccctgtcaccagttgcagaaataaaaactctcttcctccccagttcatctgcatctcgttattgggccatgagaaatagcagcccgaccctcagtttggtccaggaatacctcttcccaggactgaggtatgataccagcgggcagccatctgggagagcagcctcccaatcccctgccaaactctcctctgtccctgtccttcccaagaggtcttctgtgagcccacccaacgaagtgatggtttcactcccaccctgaggtcagctgtctcacaaagcacaagcatagatcgccaggcattcacagaagtcccaggccctttgcttgcatgtatccaagccccccctaggatccccatggaagaatttcttagcaggatgaatccttaaaggtcaagtctggaaaggaaaattcttagatgaaatctctgagaattcttagagccccaacagtagtaacaatttcaagagagttggttttatcagaggcctagagcatgcaacagggcctggtgcttccagccaggccttgagctgcctggagctaatcaggagtcaaagaacggtggtggcctgggagtcaggagccctagcctctgagaaaactgtgcaaatttgggtctctgactcatcacctctctgagcctcagttttttcatctgtaaaaggagggggttacaccagataatccctaggggctcttctagctgtatgattttataaagaaaaaaaaaaagttcttctctttgaggagtcctgagacctgacaaaaaagcatttctaagaaatacagcggagtctcctctaggaatttttcaggattagggaaagcatcagtcagtatcgaaaggagtctatagacagtatcctagggagatggagcagggacaacaggacctggggttggggtggaacttgtatctcactcaaatactatccactgaatcttggaactaagatcagtcattttctacaaaacaggcccctggccggcatccaggactctgagaacttgggtcgctgcttttactaatgtcccatgaaggggacgccaggacagcttcccagtggatgcttcactgccctcggagtgggaggagtcccatccacccactgctggaagctgagataaccaccggctgaagggaagagttggcagaacaggagatggaacacccagctaatgtgaaaagaatgaatagattaaaaaccgcaagctacttcatcagggcccacacggcaagttaagcccgcaaatatcgatgctgaaatgtgttgagaagtctgtccaggaaggccaggaaatcaggacgctcgcaaagacctgctcggagccacagccacggcggccacctccgctaatgcggcttctgctaatgaatgcggccttcaaatctctctctccagggccctgggaggactgttaacaccatttgccagctaaagagctcaggaagatccttaagttttaaaagcaccccttccatggctttcctgccctggaggacctgggtaatgggaggtgaggaggagagccagctggcacaaccccttctcctctccacttgagctcccgtgagagatgtcacctggcagggacccaaggaaggctttagagtggggaagaaaccccccacctgcctgcctcctgccagcactgatatgggagccaggaggcagcttggcaggtcggagtcctggctggagactaggtgctggtgactttctctgtctgagctcattccaccttggccatcttggggattaaaagctgggaaaggtcttagagatcaatccaactcatttattttatggtgggcaaatagcgaggtccaaaaatgcaaagagagttgcccaaagttacactgtggggatgagaacaggaaggagaagtggagatctggcataggctaaaacccacaccaagctacacagactcagcggacctcatgagcgccaaagtgacgtgtgtcagacatgcctgtgtaagacggaagacacagtgcggattcttgtgcccaccctctgggtattcacctgctaagggaagggcactagctgaaaagtagtgggagcaaacggggatcccagccaagagggagaggagggaggagcctgaatgagtgcgcatggccacagagagagctgactacaaaagggcagtgggcttcacctctgtggcactgcacatgctgacatgaggtttggggtcccttagtgcttccagctaagtggtgtggccccaggagagtcttttatctcccttttcaggagtcctcctgtcagaggcgtttgaaccagagcaactccatcttgaataggagctgggtaaaatgaagctgagccctattgggctgcattcccaggaggttaaggcattctaatcacaagatgagataggaggtcggcacaagatacaggtcataaagactttgctgataaaacaggtgacagtaaagaagccccacaaaaacccaccaaaaccaaaatggcaatgagagtgacctctggtcatcctcagtgctacactccctccagcaccatgacactttacaaatgccctgacaacatcaggaagttaccctatatggtctaaaaaggggaggtataaataatccactcctcgtttagcatattctcaagaaataaccataaaaatgggcaaccagcagccctcagggctgctctatggagcagccaatcttttattcctgcactttcttaataaacttgcctttactttactctatgggactcgccctgaattctttcttgcatgagatcaagaaccctctcttggggtcagaatctggaccccattcctgtaacacccccttgatgctaccagatcacttacgtccataggcccacaggaaaagctggagtagagggcgaaaaacactagattttgggaaagttataagcgggttgtaaacacagactgggcaaaccagctctgtcccatctgcctccaggctgtgggcatgacgtagtcttgaagataagagtcaggaaacttaatttattagcaagaattagggtcagccacatgcaacacaaaacccaaactaacagtggcttaaccaagatggcaacttctttcttctcttatacagaacaagtgcagaggtaagtggtctcaggctagtaaggcaattctggggttatcagaactcagtatccctctgtctttctgcttctgccaccctagggctgagcttccatttccaaggccctgacttggtccaaaatggctgcgggagctccagccatcaccttccaggtagcagggagggagggagtgggaagagcatctgaaggcagtgctccctcctagctgagccgcctgccccaaagtcccatggagcatggcctttctcatcccaaggctggaatttattcccacagccacacttcattgcttagaaagccagaaaatatggtcttttatagctggttccattacctccccaaatataacagagattctctcactaaggaggaaaaggttgacagctcttgggtggaatgagcatttctgcccctccttggatcctgtttctctgtgcttctggctgtgcaactgtaacctcagttttctacatctgtgaaatgaggaaaatcaacccaggctcctcccccaaggcttgattacaaaaaagttaattaaaacaaaaagacaattctgtaactcacaggaaggaaaataagctggtgagacctggcaaacgcagcgggtgcaacgtggcctggctgtcctcacggatgtccatactccagggagtgggcaattacaggctccctgccacgaagccctttgaaacataagaattcttttgaaatatgactaattaccccccacctgactttaagactagattttaatgtatgaggctttttcaaaatgaacctcacctgtgctgctgcctttcccaagcaggctaatgatagagaacaggggcaggaagccaagcggggacgggggacaatgggcagatgagaaacagaaaatccacccaccttgccgtgcccagtaggaccagcctcctcttctccaaacttttggcctgaattcctcctaacaaggactccaatgaatcccatccctcctccttccccatctagctctggtgcaggtactaatgagtgctggagggacccagggctgcgagcagccacgcagtaccgatgtggaccgtgacggcagttctgtagttacaggttgatgctccttctcccagacacaagagcctgcaggccgtggagatgagaaggcaatgcctctgccagtggggagaaggaggaagaggatgaggtcaaggaatatgaagcagcagaggggaaagaccgtaggaggctctggtttagaaaagcaaatccagcctccaagagcaacaccctagtgaggacttcactctcctcaaaggaaagttgcaataaacagaatagaagacaggtgggaaccagcctggcaaacatggcgaaaccccgtctctactaaaaatacaaaaattagccagctgtggtggcatgcacctgtaatcccagcttcccaggagactgaggcgggagaatcactggaacccaggaagcagaggctgcagtgagccaagatcacgccactgcactccagccctgggtgacagaggatgactccgtctcaaaaaaacaaaaaacaaaaaaaatggagggaaggataatgaggagaaaggaggagaatgaagacaccgatatgactttgggcagctacaactctggctatgtctgcaaagcctggaaggatgacacaccctcgtaactgcacctcagaatgcaaaagagccagggaacatttctcctgagctcacatttctgtaaggccttagtgtaaacacctgtgagatctaggggacatgagatggtgacatgcagggattccattaggcatcatggagaacctctcagctgcaatagcatcccagagagggctacatttgaggaagttttgcaggatgaataggagttcactgaatgggccaggaggaaagagccttccgggcagaggcagcattgtgtacaaagcccaagagtgtgaaacgtcaagggatgtgcagctgatgggtctggatgaatacagatttgtagggagggagagcaactggggagaaggtaggagaaaccagtgggtccctctcctagggaatttccaagttgcccatggggtgtgggctttggccagaggtaactgggagccactgaaagataccagcaagggggaagcacattttagaacaagcactctactgcagaaaaaggattttttagcggaaagacaaattgaggaagaggtagcaaggtctggagttactgcaggagtaatggggacagaggacaacagggcctatctgaggggtgttgacatgacttggaagtatgtggagggacctaggatgacccccagatttgacttggggacagggtcgagggtgacactatgagctgggtaagaaacacagaaggaggaaggagtctgacagggaagtgatgagtttgctttttttttttttttttttttttgagacagagtctcactgtgtcacccaggctggagtgcaatggtgcaatcttggctcactgcaacctccaccttttgggttcaagcgattctcctgtctcagcctcccaagtagctgagactacgggcatgaaccaccacaccctgctaatttttttatttttagtagagacagggctttgccatgttggccaggctggtcttgaactcctaacctcaggtgatccgcctgtctcagcctcccaagtagctgagactaagggcatgaaccaccacaccctgctaattttttgtatttttagtagagacagggctttgccatgttggccaggctggtcttgaactcctaacctcaggtgatccacctgtctcagcctcccaaagtgctgggattacaggtgtgagccactgagcccgacctgagtttgcttttggatatgttgattttggagtggcaggggccttcaggtagagacaggtaggaggccattggatacatggtgcaggagtgtaggcctatgtaggtcatccatgcatgcctggctctgggatcttcgctttagtcatttaaatcatgggcctgctgtcttttcttatgcctccaggaacctggccacatctagagcagagtaagtgagccacttggggagggcagaggctgctgggatggcaagggaggttgagtgggaatccccagagaggaaacctccctccccgcagcccccgctgtcccacttgtgagacggagctctgggaccaagcagtacacccacacacaagacaaaaaacttcttcctcagagctgctcacatagggagcaaaatgctgatgagaagcaaattgtctccctaggaggcctccggttgagaagcctagagcccttctttgctataactctagaaagcacagacccacaaatgaagggagagagggaggagacaaagtagggatgatagaggcaagcaatggtgaggactcaaggagaagagggagcaaggggagggcagagaggagtcaccctggggcccagagacaggagagaccagtcagcaaaggatcaaaaccgtgactggagtccttcggaagcaaccctcccatttcctccagtgacctgggggaacagatggtctcagcagctcactctgtctgggacaggtacccactcccagctacaatctcctctgagggtctggtctaccacaacccctccaaaaagcccatctttgctgttcctgagacaaagacactgctcacaggtaatcctggccagacagatcaagcctgcctctccggtgggggagtggaaattggattcacctcgtcagacttgatacctgggactgctcagaaattgcaagactatttactcccctctccagcctgaaccctggatgcagagaaataagcccactttaagggacatcgccaaagtcaagagccctcctctgtgaccctggtttcctggcttccaagaaaggaggtggctgagtgtcagtctggaatcatccactcagaacaggcaatgctttccagagatcaggcaccgagcgttggtcccttagactcttctgaaatgagggtgtggagaggatggggaggcagaaacaaaagatgtgtgagatgagaagggaaagaccacttcccacgcatggcagcttccctctcaccattgcaaagatcatgagccaattattccatcaagttagatattagcgaatccaactttattagagcttcaaggcgcatgaaacgttaatcatggaaaccttgatattctgcattagagacttactctgggaagagaaaaaaacactttcattttcctttgaggttaatacaaggctaatttgaaagcactcggttaatgagaaagctaaaaatacctctagtacgatcacgtgcctgagtcccagcctcagtggctccagcctctctagaacacgaagccagcttcgggagggagaaacagctctggactcagaggaccagcacctacgtccccagctggttacagaggcgcacctgtcctgaggctgccagattgacagaagaaaacaggaggcagagaaagtgaggcgactccactgctctttatgtccctccatggggggacataaagattttactttgactaaaatctcaagtgctaccaggagtggggatgggttttccctgagccacacatgctccctcgcccagccctgcccacaagggcagccgtgggacagtcagcgagcagggtgctcactgtggtggaggagagggttttcctccaggggaagcaaattggacagtaaccaaccccacccccaccaccaccccccacccgcccacaggtgattgcagcagctcaccaagtgaccagaagccatcatgacaagaaagggatgaattgggcaaattgagaaggcgcggtccacttcagcctcgtgggctcctgagcacgtgcacgcacgtgtgtattaaacccagagaggaatttgatttaacagaagaaaagccctcagggctggcagctgtgggagctattaaggaggagcgaggaaggttctatgtgtctgaaaaaatgatctgaggaggtcagcgacaaagccaccgggggctgtctcctccaggatctccagttgccaggaaccaggctgctggacacgggtttgaagctgccacggacagggctctctccagactgtggcctcagaacctggactcccaaataaaccatctatgggcctctgggcttatgagatgcagagattcccttctttacagtccaggctttgcaggaaaatgaagaaagcagaagttgggggaaagtgtcatgtgctctgtcccccaccccagagacacatatggtacattttatccagagctggctcctcgcagggccctggatctgcatgcggctggggccagcacccttcctccagtgtagccagcgatccccctccatgccccctgcaatgcagctcccaccgggctgaaagatagaggtggctccatctctctctgttttgccattgtcaatggcatgcttatttcaccttttactttgagtaaaatctcaagtttaaagaacaccaggaggccaggcgtgttggctcatgcctataatcccagcacttagggaggctgaggcaggtggatcacttgaggtcaggagttcgagaccagcctggccaatatggtgaaaccttgcgtctactaaaaatacaaaaattagccaggcttggtggcgggcacctataatcctagctactcagaaggctgaggcaggagaattgcttgaagccaggaggtggaggttgcagtcagccgagatcgcactactgcactccagcctgggcaacagagcaaaaccctgtctcaaaataaataaataataaagaacaccaggagcagatatttgagtgtcagaaacacacgccaggattctcttccacctctcaccctcccccacctctcaccctccccacctccccccacctctcaccctccccacctccccccacctcaccctccccaccctctgctccaacctggaaccaggaatgaaacacagggccaggtttagccacaggcaggtgggaggcagagagatctccactctcagggtgactggcaattgcaaagaattcctcttccctggactccagggttagaaaagcaaagcccacccactccctaatccatccacctcacgtttattaaaggcctactatgtgcccaatgggatgcgagcacctccaccagggaaagcccagatcgactcacataagaagacagatactagacaaataaatccactgaacccatgcactgaggagttctggtttgttagagcaaataggaagtggttttatgtgtccctgtaactccccctaactacattccgtcaagcctcccctgcctgctctcttaaagacatctggtcaaattatatacatttcagctgtgcccagctgttagcgccatctcacccctgtatttggtccagtttgttttaaaatttctgtctttgcaaagttcaaagctccactcctcccttcccatcaccatcctcagcaggccaggcctggccatggctgttgggggttttggggcggggtgggggtcctgctctttgtactctccagccactgcctccctgcctgtctggctcccccagccatgaggggctggggagacctcaggaggctctggctggtggcctctctaagtctgaacgtccgtccctggtcccactgtgaggatgggggtcacatggaccctgaaggggcccccacagcaccattccttgatctgggaggtccagctcctgccaacttcatccccgcccccaccgcttccagccccttgcctctcacccagccagggaccttcctgggtggggcacctgcacgatggttgcatctcagctccctcccatggggttcactccatgcaaggcaggggcacacaactctgcccgccaggtgggagagcaggtgacatcctggccaccgttccctggacgcagctgccctagttattcccgtcctcagcctgcatagctaggcagtctgttggctacgctgctggcctagcggggagctgccataatgtgggagagaaagtccccctttccttcttccatagaaagggagagaacagccttccttcagaaaccacacttcagcaaggccagcttcctccagcctttggttgacttggggcaagggagatgatgatgatgatgatgatgatgatgatgatgatgataataataataataataataataataataataataataataggttccgtacccattttccaggctctctcactgactcatttaatcctcaccacaacctgtgataccagtactattgatatcttcaatttattttattttattttgagacagggtctcactctgtcacccagactggagtgtagtggtgtgatctcagctcactgcaacctccacctcccaggttcaagcgattctcctgcctcagcctcccaaatagctgggactacaggtgcctgccaccatgcccagctaattttttttttttttttttttttttttttttttaggtagagacggggttttaccatgttgtccaggttggtctcaaactcctgagctcaaggtacaaagaacaggacccccaccccaccccaaaaccccgaacagccatggccacctctgcccacctaggcctcccaaagtgctgagattacagatgtgagccactgtatccggcccaatatcttcattttagagatgagtaaactgaggcaaagggaggtgatgtggcttgctcaagatcacacagaaagtgccagtagttggctctgcagctcacacccttacccggctctgaagcagctccctgagccctgtggggtggaagcaggtggcagttttccaaacgtaagatgggtgcgctgagccctttccctctccttctgggacagctacctgcagccttgctgtcagggccgggatgcagaggggggcagcaggagcgtgtgacagggacacttacttcttccagaaatggggctgatggcacctcatggaaaagaccaggcggggcctgtagcaagaggcacttgggttgctggaggaagggagggaagggatggaacctggagtgagaggagagaggggcggagtcctgggcaggtgacagcttgtgcatagcttggaggctgtgctgaagacgtgaggtttgtcttaggagcaatggaaagttggaaggatttaagcagagctaggtcagatcctaaagactggacccaaggggaaaagtagttagcacagggccctcggctgctggaaagcaaacagggctgtctttgagccctggcctggtttgccctggcctggtttcctgcaccccatccaacctaatagaggtggggggtcttgggggagaactgaggtggacgggtcttacccagtgctttgaggaccctccctaaggtgactcagaacatctgtgcagcagcctaaggcccagcaaaggaagggactgctgaggcttcctgccttgctccttccctcggggtcctgcacgcagctctccggaatcccacccatctcgggaatacatcaagctatggaagataaccctgtaatgtgcaactaatgttctgtggacagttacacagtggtgccaccgcagactcagcaacagaggatggaaggccacccctcccgcagacagggcctgccctgccgcccagctgctctatgttggggcctcccaggaaatgagaaaggagcccaggcaccagccctgcggcatcctggaggagcccgtcctggcctgaacacaaagacagaggccagaaaaccctatggtgctcagagggggaccctcggaggccacaaacccagctagatggctgtagcagctggtgcacctgtgttaaaacctgactctgccccccactcctaacagcttccacttgccgagtgctttgccgacttcacccagttaaacctttggaacggccctgtggggaaggtgttttccccactctgtgattgaggaaacagaagcctaccacggtggtcacacatcaggactgggaattcaaactctgctctgattaattcaaggctctcagctcctcggccaggacagaaggcaagccactcatgctctctgagctcccgttactcatttgtaaaagaccgatgacagctcccgctttccagagtttgcgaggagtccgtgctggcagaaggcctggcacagggctgcaacgtggctgcatttgattggggttctccagggaaacagagccaacgggatgtgcatatctaggtctagagagatatttagttcaagggattggctcactcgattgatgagggcagcaaatccaaaatctgcagggtgggctggcaggatggaaaagggaggaagagatgcagttgagtccgaaggccgttgctggcagaactccctctttctcgggggacgtcaggctttgttctgtgcagaccttccactgattgggtgaggcccaccacaccatggaggcccatctgctttgctcagagtccatcactgtcaacgtcatctcatccaaaaaacacctgcacagcaacatccagggtaatgtttggccaactatttgggcacagccgagttgacagcaaattagccatcacaacagtgaacacacacccgtggcggccgttctgagcagagatgctgccgctgccaaaggcacccacagctggtgtttgtgtgttcatggttcatccctagggatgtgggaactcacgagtgaaaatgtggcatgcacacagctctaaaggggacccgtggcactggatacccccaggaggtgagccaagctatgcccagatcctggggccagaaggaccacttcactgacccagtgttgggggtggggactgtagaaggaggtgaccagaactgggtttaaatcctggctcttggctatgactgtggagagaacagggaacctccctgagactcagtctggcctccatgaaatgagtatagtgactgcagctgcacggggcccctgaaaggaggcaatacgtcagcggatgtaaagcacctaggctggacccagcccttgcacagacgccttcccttcccaatcttaccgaagagaggagcacgtccaaagcagaggagaaacttaattaggattggaaaaatgtgaattccaaggcttattaaattcatgatatttttacttaccatgtacccagaaatatatttagcaaagcaatttacaccatcactggctgatggattgtggttttctaagttgggttttaagatgtaaatgggctccaatcagagcactgctgggagggagaaaaccttcctctccaccgccctggtccttgggctccagcctcacctgtgcagcctcccaggacggacagatggccctgcgctcccactctccacggaggctctgctggggtggggcagggagtagagacaatagaatatcaatgataacgaccatttatccagcactcattatgtgccagatgcgggagctttacctctgctactcacttgactctcgcagcacccttgtaagataaagggccctcgggcaccttaccagctgtgtgatcttaggcaaaccacttggcgctcgctcactcgctctgtgtgtgtgtgtgtgtctgtctcttgcttgctcgctctttctccctacctcagttttcctcatctgcaaagtggaaatactaataaccttctattggagaagcccagtggctggaagttagtaaacactcagatttagaaatgggtgaaagggaaaatttcctgcccaaggtcaaccagctagtaagtagtggagtcaggattccaaagcaggtgtcggcgctaaagctcttgactgtgagtggggatagacaggcacacagacacgcagacggggcctctctcatgtccacgtgtaagcatgggaggcgggtcagtgaggtgtggctagacctaccccagcaacccacacacactcccaggaagcccaggcagggatcgcgcttctgggacccgctgacactttccagatgaggcaaggtttgctccacaaggtcccggcttcgccagggcaggccagctacaagaagacgcccagcccagcgccttccttcttgtccgtcactgtcctccctctggagtgcccttgcctgaatcaagggcttgctggagcaggacaagcagctggccttgaaattttatttactgaaataatttgcttataagccagagttttaatgcaaagccaaacatcgtcctcgctccaatgaaatcatcacaatttccaaattaatggagttgactgtacatggaacacctgactggggaaggctggtgagctcagggtcagtaaccatttcccaggagggaagtgaaatgggaatgctgctgttggggctgggatatctgggtgggagggacactggctgtggggccccaagcccgctggcaggagttgggaccagccctagagaatcctctgagcgctccccttccagcgccgcgggtgaacaggctgagcttccatgctgctgggattgtgcatggaatgcaaccacccctcccttcgcttgcttccaggactatggaaaccttacttgtgctttgagatgacacttccatcaggaagccctcccagattttcccagttgaattgctccctctacatgtggacacttctgtagctccttaagcctgaaaactggaagctcctagaggccagagacctttgtcttctgctatctcagaccttccccgtattcccacccagtgctcagcatgtttataatatgtggtggcttctccagaaatgtttgttgatttgaactgagacatattctggttgggtattttttcaattattttaagaaaaaatatatatataaacaatctaagtagaattagaaaatacgtaggcagcaagaatgctcgttagggggtgcggcatggagggcagagagcccctggccgggcctcctcctgacctccccacctgccccctgggcacctcctatagcctggtcaccaccacacatgcttcagaattagccaccagcaggatggcgaggccccaggaaccatcccttgaaggagggcaacctgctgctctggaaggttctcagagaccccagaagaggctgcccaaggcctgggaaggaccccaaattacacagatctaatgttagtggcctaagcagggtatgaagatatggactgtattctggcatctcttaatattaatagttgccagcaggggccctgggaccaggggagcaacaggggtgggaggtgggagcgcaccccaccccaccccacatctgactcattgagatgctgcacagtggccaagggacaacgttctgaccttattcccccaacaggtgggcccagtgccaaccacaagggacttgggtggacaagtgcccaactctcttcgctggcccctccgagaccaccttcttccaacactcctggcaggaagtggtggactcactttagaacccggaggactcagaggtgccctaggaatctgacttgcaaatcaactgtggagtgtttaccaggccacgccctgccgtcaggactgcattctcaacagtgaaattgggccattaccctcccttgatcttgtgctatttgtctgtaatgggtgtggggctcctcctcccagcagctgggtctctcccctgcagctggccacaggagtggcagagaccctggtggagtgactgcagctttgcagggggctaactttactccagcccctgggtactgagctctgggcttccagatgcccccaaagatgagcagaggctatggacacacatcagacatcacccaagatgtgcaccctctcatttctggggggttgcaggaacaggaaccccaaacaatgtgacttgcctttgcctcaccccatcccagggtcagctgtcttagtgtcattattcccttccagaaaagacatgaatattcctcttagcctctgcaggcactaaataataataataatagtaataataataatgataacacaaaataaagagcatttaggctgggtgtggtggctcatgcctgtaatcccggcactttggaaggctgaggtgggggtaccgcttgagcccaggaggttgaggctgcaatgggcgatgactgaaccactaaactccagcctgggcagcaaagcgagaccctgtctctcacacacacacacaaaaaacatttaatatggtttttattttcaagctataaagttaatacatagtgattgtagaatacctgaagcatgcgtagtagtataaggaacaatactaaaatcggcttatccactgctagaggtaaatactgttaacgttttggtgtattctccttgagacttttcgtgtgcgcatgtgtgtgtgtgtgcgtgtgtgtacgcgcacgaacatctatgtgtctacattataaagcacagttaggattatactatatgcacttttgagtccttctctttttaattaacatgatattatgagccttttctcacccaacagaacagcctgtaagggcccccttgccttttccacttgcgttttagcccttcagagggcaaggttccggctgtccacacccctggccaggagaaggccaacccaggaaggaaagaaagacaacggcatgcattaacccggagtcaaccgtttataaagtcaaacatttaaaaggcaaagagattcacagttaatcaaatagtcgatttgtcagagggtcgaagaagataatggcttcaattttaagttccaacaaacgcagctacctcctgtgtcctattcagtcatcccacctctctcagaactaggacatcctacagttttggccatcacggcccccggccagcctgctcgcccctccacgacaggccctttcaccctccaccctgttgattccttcatcagcattccccaccgcactttccagagcttatgccaagagagctttcctttgggagtttggtgaaatggggacatgaagcctgcctggggaggggtgtgtgtgtgtgtgtgtgtgcgcgtgtgtttgtgtgtgtagggtataggtgagcagggctaagagaccgatgtaaaaggaacagcccaaggtcaagggctgggggccagcaggaagcttccgtggcacagtcatgaattctaaataaatgaagccctctaagcatttttgttcttcttttcatcagttctcaaccaggggtgacattgtcccccagacgacatttggcaatgtctggagacatttttggttgtcacaactggggggtggatgctactggcatctggtgggtacaggccagggatgctgctctgggatgcagcatcctaccgttcacaggttgccccctgcccccaccacagagaatgggtgggccccaggtgtcaggagtgctgagaatgagggacccagcattctcttctcttctttggtctttcttgcctgcttgtaacatgcacttagacccttccagatccacaggtgcagattgtcatgaatcccaaagactagtatggggtgactcagtctaccccactgaggtcaagaaaaataagtggatggaacccgggagggatgagaacacagggtgtgggtgcagctgtgaaaatttcgtgctcatgatttcacacactctcttaatgttcttaagagcctttggggagtaaccttgggacccgcaaacactttgcccccttctcaggttcggcaaggcagggtttgcctgtaaagtagtaggacagtgtctggggagcaagctgcactttgacaattgtgtgagctgaaaagaggaggagacagagacatcctggggacagaggtggcagggtaccgtctttgaaagttaaggaggtgttttctctttggagctctgtccaccaccccagactcttgagacaagtcatagttacaaaatggccacttagcatttgtggccatctcttggatggatgttgggttgacttgagggtgttctgagatgctgtcctggtggatccacaggtatgaagcccacctctctgcatggagtaccacggccacccattgtcaattgtccaaggtggcagtgtgacctcagactggacgttggaatacagagatgagcctctggccttcacctcttggaccttccctggtttggactcctgatggcaggtttggactcctgatggcagatgccaaggtgatgtcactacctggatcatgctgggaggaagatggaagagggcccaagagcttcagagagcaaaccgtcggctgcaagctgggtcacctggctccggcagccatttttctttcctttgggttcccctgacactgagtactgttttgacaaaatgttcagcaaccaagtgtccatgcatgacctagagggttcaggagggacagccagcctgaagactttaccaatagacccagcatggaaggaggctctcagaggctggaggggaaggaagcctgacttctctctggacacaccatgcctcctctattgccagagcatgaagggaaatggtggatcctctcctagtaatacttgaagtctttgttatttgggatcatttgatttttgactcttaaaaatagtccataggccgggtgcggtggctcacgcctgtaatcccagaattttgggaggccgaggtgggtgtatcatgaggtcaggagatcgagaccatcctggctaacacggtgaaaccccgtctctactaaaaatacagcaaattagctgggcatagcagcagtcacctgtagtcccagctactcaggaggctgaggcaggagaatggcatgaccccaggaggcggagcttgcagtgagctgagattgtgccactgcactccagcctgggcgacagagcgagactccatctcaaaaaaaataataataaaaataaaaaaaaataagagtccatgaggactgaaaatggtaatgaggttacagtgaaagtgagattccaggacaggctaaaaaatcaagagaaagagactggaggagaaacctcacctcctttgtggcttttcagaaatggcctttggaagcagcagcaactccgagaatgaacttgctggccccacccagcgatggagagaacatccctttcagagcagagatgcaggatggaataggtgaagagagaaatacagattccctgaatatccgtgtcctccctcttttttcaaggactccagtatctcctggaagctcctagaaaaagtctggcattcatgtgaacttaatcagcagagactcatttacataataagcattctgtgaacacttaccatatacaaagcactgtgtcccacagctagcataaggcctggcatacagtaagtatttaatatttgtttaggatttttttctttttttagatggagtctcgctctgtagcccagactggagtacagtggcacgatctcagctcactacaacctctgcctcctgggttcaagtgattctcctgcctcagcctccctagtagctgggattataggtatgcgccaccacgcctggctaatttttatatttttagtagagacggggtttcgtcatgttggccaggctggtctcaaactcctgacctcaggtgatccgcccgcctcagcctcccaaagtgctgggatgagccaccgcacctggcgtgtttgggagatctaagggtgactgagagactatccctgcagccaaggattttataagccagacgtgccggggagtaattcaaggtggaatgaaataagtacatttcctggtgtttctttggtctcagctgctcatctggaagtgaagcagagctccctggggaccagagagtatagaaaatttctttcttgagtggaccctaagaatgaatggggagatttccccagaataaaccagctcacccttccttttccccttccgcggagctgagtctagggagcaacagcagcgccatctttctttttcggaggcagaagctgtgcactcttatcagcagtgggacagacttgggctttggacccaacagatctggagaccacccactagatgagggaagcttgggtactgagccttggttccctcttctgtaaagggagctaattttgtcttcctgcagggggtggatgtgagaattgtgaacgcaaagtggtgggcacactgcaatgggtgttcagccatctgagtctttgtcctgtgacgagtgtgcacataatagcatcgcgcgtgttaaagctctctgagcacagggcctttgtatcactgatttccccgcatcgccttagtgtacagtgcaacgttcgcccatggtaggtgctaaataaatgttgttgttgttgttttgttgttgttgttgttgtttagacagagtcttgctctgtcgcccaggctggagtgtagcggcgcgatctcgactcactgcaacctccgcctctcgggttcaagcaattctcctgcctcagcctcccaagtagctgggactacagacacccaccaccatgctcggctaattttttggtatttttagtagagacgaggtttcaccatgttggccaggctggttttgaacccctgacctcgtgatccacccgcctcagcctcccaagtagctgtgattacaggcacccaccaccacacctggctaatttttgtatttttaggagaggtgaggtttcaccatgttggccaggctggtcttgaactcctgacctcatgatccacccacctcagcctcccaaagtgctgggattataggcgtgagccatcacgcctggccataaatgtctttcaatgggatatttaaaaacatatgcatgttgttatgatatatatcttcaaaaacaaaaatcgggacatgtctgactaggacaaggacacccaaggcaggcacagatgaagcactttaagtaaggccagtcctcagacgtctggctccaagatgaacactgacaaggccgtgcgtctggctcgcccctcactcccagcagccctatttttcagggggagaaggatgaggcccagagagaaattaagatgacttgagccaggtcacaagaaatatgatattccaagaattactacttcccagcttcatccttcaatatctctctttctcttcattttgaaaagcataagtttaggtaggagaaaatctacctaagaggcaagaaaatttcccatgatgttcagcttgttcaggtgacacaccaggagatggggtgagggcagaggggtgattttgtctccaaagcaggggtcagcaaatgttttctgtaaaggaccagatggtaaattgtacaggctctgcaggcccaccatctttgtcacagcttctcagctgtgctgtggtaatgccaaagcagccctcaacaatatgtacatgaatgagcgtggctgtgttccaataaaactttatttatggacactgaaatatgaatttgatatcattttcacatgtcatagaataatactcttttgatggcttttcaaccatttgaaaaagtaaaaaaaaaaattattcttatcacgcaggctataaaaacaagatggcgagctggctttggctggtgggctgtgtttgctgaccctggctccaagcacctgtgagatggtcactggatggcatgcatccacttactccacattctcatcttcctcttggaaaaaccttctggccatggggagatgcctgttccctcagacaaaaggcttagaggtacaaacaaggcactgctttctctacgaggcttctagatcgcctgccacccgagaatgtgaatactcacatttttagcttctaatgggggtggacagccagaaatcaaactagaaatgtgtgttctaagccatctaacccccagattccagcatttggctcctccagcttgagctaagaagttgcatgaaagcagccaggcatggtggctcacgcctgtaatcccagcactttgggaggctgaggcgggtggatcacctgagctcaggagttcgagacaagcctggtcaacatggcaaaaccccatctctactaaaaatacaaaaattagccaggtgtggtgatggtcacctgtaatcccagctactcaggagactgaggcagaggaatcacttgaacctgggaggcgaaagttgcagtgagctgagatcatgccactgaactccagcctgggtgatagagtaagactctgtctcaaaaaacaaaacaaaacaaaaaaaaaagaagtgagaaaacaaataatccatgcctcgactctctttgcagagagtccaggacactggatgttggaggcctcactgctagacatagtcacagagtgcctggtgcactgcttagaatttgtcctttgtaaatttaacttgaggaagcacagaaagtttgcccttcatattgtggcataaataatcgaggagcaggtaccccaggaatgaagacagaggaagttctcagtccatagtggagtgcacaagaatgatagggaagcccaaggtttgtaaaaaccataaatatctcaacggtatgcaagggcagcctggagagcatcattatctgctcccctgactgttttaatatgctgggtagagaagcctgataaatcaccggaggctgcagggcttggagaagatttggctggagctaaaagaaggcagcccatggggaggacaactttagaataacctgaaaatacacagacacgtgcctgcagacagacactttcattcattcatccaatatttatttcctgcttatgttgttccaagcactggactagatgcagagagaatcaagttgaagaagactcagctcctgcccacacggagcctgggagcaggggaaggctggaagataccgattggaaaggtatctcaggagcatgaattattgccagggcacgggtgatccaggggtgcaccccgcagagcacctgcccccttgtggaagcccagctacctgcagcctgagcgctgagaacctgaccagcacctgcagagactgcagaatgatcctcagtgggtcctcctgagccgtcctgcctccacctcaagcccctagcagagaggatcccggccagccctgagccagtacaatgaaggagacagctgaacttaatctaccgaggctctactcctcttcctgcttggaaaatctccatccagcccgctcagcagagggaactgccccaggaagagaagagcggtgggctgaggggccgggtggagagagtacagagggaggaagctaagtaaacacccagcctctgtgctcccccgtgctgcctccgcctggtcagcaccctgtcgctggcattgatggtttcatttttctggagagaaaaagaacaaacgcggaagataattgtagtggaacggccgataagtaacgtttggtctcctttttacaaccattccctagggccatattatgataatttttcttctataactggcaaattgtataacgagtcagatgataaaccagcaagcaaggcagaaatttgcattttaatacaactgctggtatcactccccccaccccccatcccggggagatcagggcctctctgatcctaggtcacctggcaccctgccctcctgttcccttctctgagtgagtgagtctggagcactcaataaatgtagcattttcaatgaaagcataatatctgttttctccagatattatgtagcatagagattacgattcagggccctggaatctgccagctgagccctaccccagctccgacactgactgaatggctattcttagtcaggatcctgaactatgcctcagtttccttttctgcaaaacgagcatcattctactctctacactaggggtttttctgtggatgcctggtgtgcagcaaatgctcaataaatattattagtaatcgtgtcatgatggtctgtgtggaaaaaacttaagctgcttttcctctctcctcctatcacaatcaacacagaagatttctgtgcccagacatgtgggctttttccccacatgccaagcaagtcatcaattccgcagggaacatcagctaggtatcctcccaccccaattcaatcccaacaccatctacctggaaatagcatcagatcacaggttgggggctcggtcccacaagagtgacccccacatttccagtgcccatcacaagccccagtttgtttcacctgggcttctgacctgctggctgtaaacttggcttcccacaatcctcttctagggttcgattaatctgctagagcagctcacagaactcagggaaacaccacattcaccgctatattctaaaggacagatgaaggatagagatgaagagatgcacaggtgaaggtatgggggaaggagtgtggagtttccataccttcctcctgaaacctccatatgctcagctatccagaagctccccaaactctgtcctctttggccctctatggagacttcattggataggcatgattgacaaccatatagacaaccatatgtgactaaacaaaaagggtttgatcttaatactaacagactgagggggaaaacccagccaggcctgtctgttcagattcttcttggcctctctgtgcagccttccttcctccagggtatagggcaggacctcttctgaaatgggggcccctattgacttataatcagacaaggaaggtcagagaatttctttatggctggccccaagacagaaagctggggaagactggagtcctgccttggccaggtaaaaggagggcaggagaagttcagagagagagattctgtttttcgaggcctgcttttgaggcctaaagccccccaacagtataataaggaccatgggagtcatgagccaggaaccatggacaaaaaccaacatagcatagatgatattctaatatcacaggtggtgatgatgatgatgggtccaggtccatagggcagtggttcccagtcaaggccgtgttatcaagccagcctctgtccctcacctgtgctcttgtacacacccccccaccaccaccttcagggccttagcactgcctttatattcagagcctgggagtcctggaaagttcagagcacacaaggttaagggtacacaaaaagccaggtcatgggttatggaagatcacacagatgtgtacacatcaccaccagccagcccccagggcccagaactgttctggtcaccccctgggcaagtccagttttagaaattctagaatcttccagataaacgaagtggtagaaagagcactggccttggagtcacaggcttgaccttgaagccctgcaccatcacttctgtctgctcagctttggaaaagtgagtccatttcccatctatacaaggagtaacaacatctatgcttctgaggactgaaagggttaacagaagcccacgcctggcacgcaacaccagttaaatccaccaattagctgactcggaaagaaaggcgctaacaaccttggccaacttttcggtatggtggttacatttggcagggactgcccatcctttcatgcccaagagaagctaagtggtatccagaaaatcctgccaaaaacaagtcttgattattattttagctccaggagtgaagactttggggacttggcatgccctattgtttgaatttatagacatgggcccctccaataaccagccagagggaggaaaaggttgctatcacaatggattttttggagagttgtttttagaatttcctacaaccccttgagaccatcagaagttccaaaccagggctgggaattaagtttgtttctgcagtgtgatgaggcttctgtccacctcactagggtatagggggtaggagctgctttttctacacaaaatgaaccacagaccatgatgaggactttggtggtggtgccacaactgagatcattcattcattcaacaaacatgtattgacttcagtttatgttccaagcctgatctaagtgattaggatatataagaaaacaaaacagacaatacttcccaccttcatggggcttactgtgttctagtgtggagacacacacacacacacacacacacacacacaagaagtaggtgaattgtatgttggaaggcagagtgctaggataaaatagagcagaatgaggaagcacactgaatattctttttcttttttttttttgttatttttaagaaatggaatctttctctgttgcccaggctggagtgcagtggcatgatcacagctcactgcagctcactaggctcaagcaaccctcccacctcagcctcctgggtagctgggatcacaggctcaggaatgaggaaccaaacctggcttgaattttcaggagggagtgtggatagagtggattgttgtccccagttttccacaccctcctggtaacagaatctaatatcctggctcttggtgggtgacttagcagtgcccctcccacccagaggagttgtaataccttttccgccccatgatgctgggcttcgccgtgtgatttgcttgggccaacgggatgtcaactgctctgatgcatcagaggcttcatgtgtgcttgtgagccttagtttggcctcctgtgcctctgtcattgctatgtgaagagcatgcccaggtgcatgaagcctgcagtcagcctggctcagccccacccagcctgctcagcccaatcgcagccaatctgtcaaccactaacatgaaataaaatatgacttaagacttctgtactggttttctattgataccataacaaattaccacaaacctagccacttaaaacaacacaaatctatgatcccaacagctctgtgagtcagaagtccagtttggctccaggcttcagaaggacaaaatcaaggtgtctgctggttgggcttttactgggaggctgtgggaagaattttctttcaagctcattcagatcattggctaaattcagttctttgtggatgcagaactaagattctcatttttttacttgctgatggctgggagctgctctcagcatccagaggcctctctctctggttctgacatctcagaggcagcaatggcacattgaagccttctcatacttggaatctctcctttcttctgcttttccatctgctatcaagggcttgtttgattacacagggtccacctagatagcccgagtgtattgtccattctcacgctgctataagaacataactgagactgagtaatttataaaggaaagaggtttaatgggctcacagttccacatggctggggaggcctcacaatcatggcagaaggcgaaggaggagcaaaggtttgtcttacatggtggcgggcaagagggcatgtgcaggggaactgtcctttataaaaccatcagatctcatgagacttactcactatcacgagaacagcatgggaaaaacccatccccatgattcaattacccactgccaggtccctcccatgacatgtgggggttatgttaaccttgctcagacattagtgtttgacaaaaaggatgggaatgttggaaacatttttagggttctgtctaccacaacctataatgtagggttcctgggactgtttgttacacagtgctagcactacagaaacctggctctcacgatgtccaagatagctctcactgagaagtaacgcctcagcaagagccttctccaagctttctttttccttcctactggattgaacctacttcaacccagcttgagccatgtctatgacaacagtacctaggggaaggcaggacaacagtacctaggggaaggcagaacaacagagcagagcaaactgttctcccatgtccatgaagagcagagaggccccagcaatccaaaccactcacccctcaagtattgggtaagagagaaaggcactttgttatttaaaccactgcgttattgcttaaacaattgtattatagcagcttagtcttttatcaatactaatacaatatctaatacaagaactatactacaaggcaaataaaccaatggacacgagccaccttgggggaagcagcagcatgttttaccgggtaaatctcaaaaggttgcttgcgaggggtgtatggccttaacctctaaagttcacaagtacagtagacactcgtatatgaaacaatgtgcagaggatggacaaactgagtgactaagaatgaaaataaatgattcttattaaagacatgcaaaacaaagaagaagggcaggtctaagagggtcaagaggtaaggttaggagaggtaccaggagaaccaagaagccttcacggtaggatccgtatcactggctgtggctggactagatgggggatcagcttagactgaggagttgttaatccatgagggagaggctgggaggtagagagtgacatccggctgagtcctgtctgtgcctgtagcccctcagcacctaacaacaccacactgtaagcgcccaggaaacagctgtaaattgacaactcagaagaatgaatctctctcctccaccttccctagaccaggagatgcccccgacttcaatagcaaagcagagatgaacgacctcacgatgacaaacataccagaatgtcatgaggttgagtttctgttcattcaatcagcatttgcagggctgggtgcagtgtggccataaaggcggatgagctatgactcctgtcgttaagaagcttgccaacttggagatgatacaagatatgcaggtaggaaactaggataaaaaggagaaactgatgtgcaccctgacaaagtgtagagaaagcgttccgagaattccaaggagaaggaatgcttcctgcttgggagggtgggaggggcaggagaggaggccgaaggcatgaaggcaacaccgaatgaaggctaaaggcgtttgagctgaaccttgaaaaggatcaaggctggaggcatcctggcagcatgcctgtgtgagcaggctggggaggaggagggtgctgggtatggctgagatgaaggcaggtgtggggactgagttaggctggagcctgacccggttccataggtttacaccaccactgctgttccctctttctacactgaagggaaaacaatagatgtttaagtgttcaaaggtgaggactgggaggccctctccattgttccttattctgagagccttagaagccctagcttttgtggctggaagggatgttcaagacagttgcctctacctgaggctggagcccctcctgctccagcacctatggtttcctcccctgcagcccagcagcacagtcctgcagcggcaggtggggcatccctcccgtggccacaaacccacccaccctctgaagcccagcccaagggatgacttcctgttcacacacacacctgcacactctctggagaccaactggagggagggagaagatgctgaacccgagcagcaccttttgctgggcggggagccctccccgccccctttcctatcagtgtgtcctccagtgtgcccagaacagcccctttcctgttcacctcccctcccacccttcctttctaagcagggagagaagtggctgtgggctagaaaaatgcccccaaaccttccaggacaaaacttctggggaacagtgattccaatgggaggccagagctagcagctctggaactggtagcagcgcttagggagcaggatggggggaaactcacatttctagagaagtggaaggctggggaggagaggccaaagccgccctgagccaggtacatccacgtccacacacttctctcaaactctctcgtcaaaatgagacaaacaattcttccagaaacccagcccaagagatgttcatagcagatcctactgaaaagtggggatggtgggggcagacactaaataattgaaattcttgagagctgtgtggagaggcacgatattctttgctgcatgtagaaaggttaataaacacgggtgacacagggcagtggctggggactcgcggtgagcagaaacacttcccagaaggaagctcatgcctgggtttatgcccagggctggtgcgtctcacaggctcagctcctcctgctcctgcctttggtctgctagtcccagaagacacctctgaggcacccaggggcggagacagacatgcaagactttctaaatcagaaggctgggcaatgtcccgcccaaacgccctcactgggcccacagaaaggatggaatccagcctctctttatctttccttaaaaggaagaggcagaaggagaagagtgtcatgtcctgagcctctgggccagcttccaggggtctggtcccatgctggaaccattcgagatggaccctccggggctggctgtcttgccctgcatgaccctgcgtcccctcacaatgaaggctactgagtggggacacctgcaagcagccctcagcatcacagcaccctggtcagtgtcccagacaagcttggatgtggacaggtgtgcccccgcgtgctctctggtagctgggaaagccagcgtggaggtgaaggaggccctgcagggagtgaagattgcctcaggcacactgctgtccacccggagtccacattcaagcagcagtccaggcacgggcccgcttctgccctgagccccaagctgccagcacttggcagccagaacccaggatgtctcaggatgctgccgggtgctctgatctccctagcaagtgcctggcggcagtggttcaccacctaaacgctgcatccggaatctgacagggaaacaagtgcttgggtgacacccaaatgcagcatcaatacagacatgctgacatttccatctgcccctcggtccccagagtccccatgtgcaagagaagccacaggcaaaaaaagtaggtcaccccatgctggtggaacagggcaggtgcttaccagttgctcagctaactgcttctggggcagggggcattgtaaggatgcagagaataaaggagggggcaatcctctgcccgattccccaactaaccggcagctggcacgtggcagtatgcttgggtctaggccagcggttctcagccctgattttggaaggagttttatttgagaaaaaaaaaaaaaaaagataaaacacaaatgtctgagccccacctaaaaccaattaattcaaaatctctcagaaaaagagactgaagcatcaatgatatttaaaagctctccagggatcaggtgtggtggctcacacctataatcccagcactttgggaggccaaggtgggcggatcacccgaggtcaggagttcgagaccagcctgaccaacatgaagaaaccccatctttactaaaaatacaaaaaattagccgggtgtggtagtgcatgcctgtaatcccagctactcgggaggctgaggcaggagaatcgcttaaacctgggaggcagaggttgcagtgagcagagattgcgccattgtgctccagcctgggcaacaagagcaaaactctgtctcaaaaaaaaaaaaaaaaaaaaaaaaaacagaaaaaacaacaaccaccaccacctctccaggtactctgggaatgtgggaatgtgtggtcacagtggagctgctcctggtcccagcagaggatggcccttcccctctgtgatcctgaagaggagagaaggactgggagggagaaggtagttcaatgctgaaaatttctgtatttttttttatacttctgcagccttacacaaaatggtcccccatctggaatgcacccttcccctccgcttacctgcatttgactgactctccaaagcctgatttcagttcatcttcctctgatcccaggacagggtgtgccctgttcattgtctcctgtttcctgtcttattcccccaacagcccctgcactcctagagaccaaccattctctaaaatgttagagagacaaattctcagtctctatccgatacctactaagttagaaaccctgggggtggggcccagccatctgggtcttcaccagccccctgggtgaggctgctgagagttcctgttccagagtcactgtgctggtctctagacccagctactcaaagagtggtccctggaccagtggcctcggcctcacctgggaactggttagatgtgcagaatctcacaccatatcccagatctatcaaatcagaatctttatttattcatttatttatttttttgagacggagtattgctccgtcacccaggttggagtgcagtggcacaatgccagcttactgcaacccccacctcctgggttcaagagattctcctgcctcaacttcccgaatagctaggactgcaggtgcacaccaccatgcctgctactgtttgtatttttagtagaaatagggttttgtcatgttggccaggctggtcttgaactcctggcctcgactgatgtgcccgccttggcctcccgaagtgctgggattacaggtatgagccaccgcaacagccagaatctgcattttaacaggatgtgcggggggtgtgcatgctggggaaaatgtgagaagtgctgccctcttcaggaaatgagtcgacggactgcctgaaaagggaagggctggcaggcttcatcaccccccatcacgagggccatgtccccatcccccactctgttccaggagatctcagccttgatcacaagctgcaggtgctgggagcctacagagagattccagaaaggtcatccaagaaacaaatggcacagccccttatccgcatacgatcaagttgaagatgtgtctctgaggtgattgcatcccagctgaccacattctagcaccatccctgaacatgggccagtgctgaactggacccattgcaactgcccagggagcttggcttgctttataagggccacccctgaggagtaacagtctgaattgccccaagattgtcatctaagccaagcctcctgctccctcgtcctctctcctgcaatcttgtccctttcagccttccctaagcacgctctcctcaaatgcaccgagaagagtggcatcggacctcagttccgggagtgggactcaggccgggcgacagagacagagaagggagagaagaggatattgtgggatttccctgactccttcctcacgggctcccttccgttcacttcaaggaacacttgaacgcctactatgcactcagcacagtgagtcccttctgtccctgctgaactcccacattagaggttgttaaaaaaaatgtattcaatgagtttgatattcaaatacgagcttctcctgacaggttataaatagcttctttgagtccaatttgaggttttgattttttttttaatgtaagctatcagccatccatctgtgattgaatcagagagcctcttctccctcctccctgaaacccatcgtcaaaggccattactactttccctactcagagaatattgggtatggagctttaatgtcccctggggaagagaccattacaggaaaagaaaaaaaaaaaaaagacgtatttccatctctgttccaatacgcacaacctaattaagatttcataaacactcacccaacaggaaaacacatacgcacacacattcacaggcacctaaattagcaaggcaaatagagtctagattaagtggttttcttgcctgtttccgtccagttttaattaggcgtctgtcacaaggagggtgtcacgcagtggaattgtctcattttgattctttaggcttgggatgttgggttgccagatccccacacctacacctttttcctgagaatcacagctctgtcttccctgggccactctcccctccaccctcacctcccgcctgctgtttggggcccggaggaaggaggaggggcttgtccccaagcagtcccattttggtggcctccctatagcaccggctcaccaggggacttgaccctggcagacccccactgtgggactgcctggtggcagtggggacctgcatgcaccctccagatgccaggctctgggaatagaaagtacaggctccctgtgaccccctcacccctcattcccgaatgccagcagtgcagccccccagcactggtgtccaggaggctgccttgagggctgctctcagccctgccaatgtcttctctcccatccctactgctgtgctccctcatagaagaaaatacgaaagatgattcgctttctccctctttgcagatccctggggctgtttggaaaagtacattttcttcacatgtgtagaaaattaaatctgttgtgtttttgtggagcacgggaggggggagttgggggaaatgtcactcactcattcgagcagactaggggtcgggggtggaaagtaggatgggagaagctccagtcttctgaatgcctggttagggacaggctgggaggtgccagctgacccaggctgcagacttggcctcttggtcctgcctggaaaccgcctcctccttggagcaactcttctttttttttttttataactttaagtcctgggatacacgtgctacagtaaccaaaacagcacggtacgggtaccaaaacagatatatagaccaatggaacagaacagagacctcagaaataatatctcacatctacaaccatgtgatcttcgacaaacctgacaaaaacaagcaatggggaaaggattccctatttaataaatggtgctgggaaaacgggcaagctatgtgcagaaaactgaaactggatccccttccttacaccttatacaaaaattaacttaggatggattaaagacttcaatgtaaaacccgaaaccataaaaaccctagaagaaaacctaggcaataccactcaggacacaggcatgggcaaagacttcatgactaaaacagcaaaagcaattgcaacaaaagccaaaatagacaaacgggatctaattaaactaaagagcttctgcccagcaaaagaaactatcatcagagtgaacagacaacctacagactgagagaaaatgtttgcaatctacccatctggcaaaggtctgatatccagaatctagaaggaacttaaacaaatttacaaggaaaaaaaaacaaacaatcccatcaaaaactgggcaaaggatatgaagagacacttctcaaaacaagacatttatggagccaacaaacctatggagcaactcttagtttcctagaacaaagcaacagctacgcctacccggtgacatccaaactttccaagacaggctgcagggggtgcaggaagaacgaggctgggctgcagcgaatgaaaggtagtgacttgtcactgtgaagtggacccagccccctgcagcacttgtccatccgaggtcactctgcagcctccttctcctcccacaaggacgagggtttggaggcctgtgaggatgcatgtgaaggtgtggggcccgtgatcccaccggaacgatgataaaaccgaggcctaggggagactgtgagaactaagagctcactgcttcctgctcaagagacaaagagaactcgttaattaatagatccttccaccccagaaggatgagggctccaccctctctctgcccaacagaggcagatgtagaagaaatcaatgcaaaagaaaacagaggccggacacggtggctcacacctgtaatctcagcactttgggaggccaaggcaggtggatcacctgacgtcgggagtttgagaccagcctgaccaacacggcaaaatcctgtctctactaaaaatacaaagattagctgggcgtggtggcacacaactgtagtcccagcttctgctgaggaggcaggagaatcacttgaacatgggaggcagcagttgcagtgagccgagattgcaccattgcactccagcctgggtgacagagcaagactctgtctcaagaaaataaaataaaaaaaataataataatagagaacagaaaagctgttaggtcgacttgaagaagtagctgctagctcagtgataacttctcaagtgcaagtctctggatgaggtgaaacaggtgagtaataccacctgcctttgagatatttacagtccagaaggaaaattattaactctcaaagcgatgatgaccaggcagctgggtaggaggccgccatcagctctaaggaaatgtggacgtgcgatgctcaggccagcggactgaagctttgccacctccctctgccggtcacaggccctgctggaagacaggctggccacctgtacctgctgtcttctggggccaccgttctgccctccacccagggacagctgcggccaccacaaaagcagcctggctctggtgaattagctgaagtgacactcactttgtatacacatgtttacaatcagggccagatggtgaagtattggattcgtttcaacaccactccagcctgctcagctgagccgggctttgcatgtgacacgagaaccacaacacagggaaggggcaatccccttccttagacaccatccccgaatcccaggggatatttattagccctcacttaaaagtagcctcagcttaccagctgtcagaactttttttatcaaatctcctgaaattctacagacagaagaaacataacctcctctgatatcttccagtttctttcccttttttttttttaaaaaaagtaaataaatagataaagcacacttgatggaaaggagcttgcaaacgatcaccgatgacactgtttatgtcgccaaattattcatactgacaggaagagagggcagactgaacacagatcaaatggagtgattatttaccaaccgatgaggacatccttaggtgacatgacagagaaaaggggtgggggaggatgttgacaaagtgccagagacagagttgagcaagtctgcgtgtttccatctgcttcctccccaaaagaaagtggcaagggggcccttgaagacagctgcactgcagagccagaaggatgggactgccggcccccaaggagccccaggcctgagtgtccagctggcaggccaggaagaaagaggaggagggggctaaaaggtggtgatgacaagaggaatggccagtccttacccacttcatctttaccaagaaaaggtgccctcccaaccaaacctatgataaccagatataacacaagaaaaagagagagatacagaaagaaagacagagagagagagaggaagaagaagaagaagaaggaggtggaggaggagaaaaaagaaaaagagagagagagaaaggaagaaaggaaggaaggaaggaagggagggagggagggagggagggagggagggagggagggagggagggaggaaggaaggaaagaaaaagaaaagaaaagaaaagaaaagaaaagaaaagaaaagaaaagaaaagaaaagaaaagaagaccacagacaggctcttgtgatctccaatggtggaaatcatatggtctatgtagaaagtaacaaactttttggaaagaacatttgagaactcctccatcagaggaggagttcaaatccaaattgtccctctgggaggctgtagccttattcctggaatgtagccattactcaaaacaccttattttgaaatgttccttttgaaactccctttagagtgagttcgtgagaaatgttttatagcacaaagccataaccttggctgtgtgtgtagggggagggggcgaaggcgaaggtcggggtgagggtggttctggtgtcagaactctgaaattgtttgggctggagcagtttccaaatggtgactgactgaccaccaccacccccaaaacaaatctgaccccaaagaaacagctttcttaccttagagaatgttcagaggatctgtctgggctgcttcttcaaggtaattccaagaggttgctgcagaaatgatttcagctacagcaggacaactgagcatgatagtggcattacagagtggtcactacaaaaaggaaagagattatactctcttgaaagagcacgcacacacatataaagttagggcacaccttcagagattggccccagtcatctgcctctattaaatcagtcatttattcagccttgtagataagcatgggcttatctcccctgcaatcggggctcagggaagggtgggaggcagaaggaagaaatagaatgactcattaatatcacttggcctaatatgctgggactgagaagttaaatgagagaactatgggattgaaaggtagactagacagttttctgcccactattatttaggagacactgcggcaagttgagagtgagctggttttcattcctggctaatgaacgcatacgatctaagaaaggggcggctggctggaaaaaggggatgagagccttttcccattctcctttgtcaggcaagagccgaggaagttaggggtgcacctggctgggaggaggagaagaacccgaatggacatctctctgttttgctctggagagaatgaagacatcctcactctaggaacagggaaatcaacctatgggcagaaccagcttctgcctctggttgcagccattgtctggcccctgcagacaacttcctgaagtatcagaatgcttgccgaccacagagaatgacactttctggagcctgcaccacgagcatctgggtcttggggacaggcaaagcccctactgcccattgtggaaaccaatgcaaaaggagaagccctgtttcctcagatgaaggttccctcagtccaaggggcatggcttgcctggagagggagggcccaggatcgatcccatcacaacatgtccagcctgacctgtagtacttcttacttggtagctcagggctacaaaggtgaatgtaccaagaaacccaggcagacgttgtctggctttgctgacctagcctcagaagccccatcatgttacttctgccatgatcttcggtaggagaagcagccacaagtccaccagattgaagcaggaagaacagatgcatcttatctacagaaaatatctgtgctcatcctcactgcaggagcactggctgtgaccactcagagactggatctcagaagcaacatgacctccttggacatcaggacattgggaagggtgttcaggacctcaggcctctactttttagtgtttctggattttgaaataaaaatgaggacacccagaaaatatttggatttcacataaatagcaaatagcttatttaatataaatatatcccaaccatcctatgggacacacttatactaaaaatgactcattgtttatctgaaatttcagtttaacttggtgtcctgcattttatccggcgatcctctgatgttttccctccacaacacatcctctctaccctctcctgttccctacaactacagggggtggggtggaaaagataattgttcaagatcctgaagtgcatttctgtgccagccttggagagatataaaggatgatgtggccccagtaactactgctgcataacaaactaccctaaaacttagtggcttacatcaaccattttattatgcttagagatgctgcagaaatttagacagggcactgcaggaatgacttatctctgctccacaatgtctggagcttcagctgggaagactcaatggctggagataactcctggaggctggaatcatctggaggcatggtcatcacctgtctggcggttggtgctgactgtgggctgcgacctcggctggactctgcaggagcatgtgcatgtagcctcttcatgtgacctgagcttccttacatcatggcagcctctgggttgttgaacttcttacttggtagctcagggctgcaaaggtgagtgtcccaacagacccaggcagatgttatctggtttttccgacctagcctcagaagccccatcgtgttacttccaccatgatctactggtaggagaagcagtcacaagtccaccagattgaaggggggtgaacagatgcaccttctccacaacaagagcgccaaagaatctgtgggcttgttttacaaccactggaggtggagaaagtggaaggaacttgcggtgagggaggggctcacagtgagactgtggaggtagaaaatttctgatgacaacgaaggagcctggagaggttggcaggagtggagctgaaggtcagagaggttggaaatttgggaatcatgagccctgggtgcaaggaggacccggaggggctagagctgaagtcactggagatggtagtttgcagaggaaaccgctgtggaagagggaggagagacagcaccgagggagtaggagccatcaggaaacatcagaagcgctcatgtgccatgcacagctcacactgcgctttatcaaaatcggcgtctgtcaccaaaattgcgttcgactgacaccatctgcatcgatcctgctcacagtcccccaggctccctctccactcccacccatctgcacacgctgagtctctgcatcccccgtctccgctggagaacagaaacatctgcctgcagcaaagccctctctcccacctctgcccaagatgggttttggctgcctgcacagggcctgggactgtctctgcaaacctcagaacaggctcactctcaggctgagagaaacatgtggtgacttttagggagcagagagtttggtcaaaacagaggggccgagaagtgggggcactgggcagcaacgggcagcaacaggcagctgagggcccacgcacttcaatgcactccccatcctttccacccccacccctgccttgacggggagggagcaaccttcacttctgctgctctgtctggggaatggatgctcacagcagccctgctccccagcactggcctctacgaagccagcaaggcagctgggcctgactgttacggaggtgggaactggcaccacatggagatcgtgccttttgaagcctgagttaattggattttacatcatcctctcttgccttccccatctttattaaatgaccaagaggagaggagaggagcagctgatcaccgagaaggaaaagtttaggacaatggcctctttgtagaaagtaatcaatgctcagcctctcccaccacgcctcctgatgttcaggctcaaacagtgcctcgaactcagggagtgtgcaaaaagatcagttgcctttattactattcttctcattacccgaaaggtacaatctcgctcacatatgtatgtaattatgtgtgcaagcacacacgtgtgtacacatgcatacatccacacctggctaactagtgacctggatcgaccagttacctgcccaaaggaccagggcagggcctcggatctgctgtctgtggtcttgtttggatggagaattgcctgcagggtccagagctccagcagctgagccatctcaggccttagtggcccctgtctgtcctgtcttacgcatatatgtcctctcttcatgctatacgagggtttgaggatccttggagagttattccttcctctcacttttctaggtccatcatttaagggaaaagcgtggcttattcaagcggatgctggtgaaattggctagtgtgggagacagaatttgggtctaggtccttcactccctgtggcccttggccgggcctccaaggcaggcagagagaacctccccacccctgacttcaggctgcatacaatgcttctgccagtggggtaggagcagatgctaaggaaacaaaggctcagtgtgagcccacaggactggccttgccccctcagatttgagccacccccacaaaaagaacgtactctggtagcctgctggtccaaagaagatgagagactcatggagcaggatctgattccagccccagcctggagtcagggtcagcaggggttgggctggatgagctgagccccagccgacctgctgagaataaatgagcaccagaacagaggctcactggtgtgcgccagcaagattatacggctgttctacgggactctacgtgaccacgactcactggcacagtgcacctcacgctgcatacagaaatacattccagatgcacttaaaactaaaggaaaaaaaatcaaagcataaataagttttaaaaagactctcaaagctaaaaagcaatgaaatattatgaagaaacaagatggatgggtttaactgcagaagtattaaacgactctgcatcacaaagcattataagccaattgaaaacataacataacacctgctaaagattaagcttaaaaagttttagtcccatttccttaagacactaaagcaagcagccatggaggggacgtgtataaggatccaaggcagccccctttggcagaggggtgggaagaggtttttaaatacacaatgctaaaatgatgtcagggaaaaagaaatagcttctatctagaagtctaggatcaaggagagagaggaacacagtcctaaggagagaagcaggaaaagaaatcttcatccaagtttaggacacgtgaagccaccctggcatgtggtcaacccagaactacagcaaagacgccctttgtccatccaggagctgtttgacacagaagcatttccaggggcgacaagcctggcaacggctctactgtgagtaggaaccatgattggcttttgctgcagagtctagtccagcagggcccagccatagtattgatgggagcttgtacagccaggcctctgagcctttgcaccacaaattggcttccaggagagatgcttcatgtcctgggttccctgtgtactctaaggggatccccaggcactaggaggatcaaccaagggaagacacctgcaccagaactttaggtatgggccggcagatcctgtagtgcctcaaactgggaactgagggcagcatatatccttgttatgaaagcccaaattaaaatattgaaggtcctcattagtcaagaaaaattgggattggggggaaagaaagaccacaaagtgaatccacttaaaaagacggaaagaggccaggcgcagtggctcatgactgtaatcccggcactttgggaggccaaggtgggtggatcatgaggtcaagagatcgagaccatcctggccaacgtggtgaaaccctatctctactaaaaatacaaaaattagctgggcgtggtggtgcgcgcctatagtcccagccactcaggaggctgtggcaggagaattgcttgaacccagggggtggaggttgcagtgagctgagatcgtgccactgaactccagcctggtgacagagtgagactccatttaaaaaaaaaaaaagatggaaagaaataaatgtttgattgtaactttatatttagaaaaaaagacaaattatgaaagtttattttagcttacatttgacaaagtaggctattaatgcaactttttaattcttcagatgaaaaaagaacaagatattgatttgtggggacatactttttctgacgagattgtctgagagcacgtatgatccaacagccttgatttcacgtttgactttctcagcaaaatcaccaaaaggacatttttgcaaaaaaaatattggaaggcatcaattttcccaatggcctgtcttaatcctctaaaattcaaatctctctcgtttgaagtgcctgtcatttcatcagccttgtagattttcccttctgtaattgttaaccggctaagaactctgccgtatcctcattggccagtagctttgcacatgatgcacgtgattctccgtaatcactttgatcaacctcaggaaattctgcatcttttgcaaaatttgaaattgtcttgcattatcctccagagtgtttgcaacatatggccaacaggaacaggcagacccacaaatatgataatacaggctggggaaatatgctggagttaagtttaagggatgcaggaagacgggcagagtttataagagatcatgccaagaatgaattttttttttttttttttgagacagagtctcgctctgtcacccagactggagtgcaatggtgcgatgtcggctcactgcaacctctgcctgccgggttcaagcaattctcctgcctcagcatcccaagtagctgggattacaggcacgccaccatgcctggctaatttttgtatttttagtagagatggggtttccccatgttgtccaggctggtctcaaactcctggtctcaagtgatccacccacctcagcctcccaaagtgctgggatgataggcataagccatggcacccaagcaaaaatacgcccaagaatgcatatttttgtgttgcaatattataacttcaggaactgatactgtagtaatatgagaaccaaggacctctgtataagatcaagggatgctaaccacaaaatgtaaagagctcatagaaagcaatgaagaaaaaatgggcagaaacagaaaccttttctgaaaaacaagatagaaaatgaaagagagtaagaaccacagggaagaatatttattaatagcttcactgtaagcaaagaaacatataagaaagcaatatttttgccatcaaatgaatgttttctaaattataattctcaatgctgctaaggttatgaagaactaggccttctttgtgcaccgctggtagggtgtaaattggtacaggctttccagaaaggaaatgcaaaattatatccagccttaaaatcatttcaactgcatcatagttttttataaagtcccatgttgtctggacatatcctcacatcattcttaaaacgaacaaagactaaatcaaatgttgattttgagggtgtaatttttcttggggaaagaaaatcatctagtggcacaaaacaatatccttcactttgagtgaagttaattgctttttcagctctctctaaagtttgatctcccactcagaggccacttcacacaggaaggaaagcctctcccctctggagagtgcccagaggaaggggcgtgaagcccagcagagttgcatccaggcacccacgccaaatagcaagcagctcctgcctcagccaaagggctactcgcacacctgccccaggctccctccctcctcagcaaatgaaacaacagaacattacaggtttgtgcctgcactcccaggtattgagaagctggggtgtccatcaggagtccaccaacacacccacagtgaatatcttgaggtgatgggggtaggaagttttttcactttcttcttcaaactttctgtggatttgtaagtttctacaatgaaaaagcatcacatttacaatcataaaaggatatatatttttttaaggaaacagagaggaatagcattaacaaagcacagaagtagaagtgaatggaggaatgtggaggaaatgccagggcaattcagactctggaagcttcagtggcagtgagttgggtggaatcagatggcaggatcccacattacctggattgaaagatcatggctctgctgggtgcagtggctcacgcttgcaatcccagcactttgagaggctgaggtgggctgatcaactgaagtcaggagttcgagaccagcctgatcaacatggtgaaaccctgtctccactaaaaatacaaaaattagccaggtatggtggtgcacgcctgcaatctcagctactcaggaggctgaggcaggagaattgcttgaacctgggaggtagaggttgcagtgagccaagatcgcgccattgcactccagcctgggtaacagagtgagactccatcaaaaaaaaaaaaaaaaaaaaaaaaaaaagcatggatccttccaagtggtgaggagccaggcagccccagaagaaggccatgccatggaaggcacagtatggaaatggaggggaaatatactgttctttggagaaaccactgtgctgctgaatcaactcccacctgaagtgtaccttatctctggacttgcacatgcaccaattaatccctttaatttttttaagacactttgagtcaagttttctgtatgtggtaacacaaagcatgccaactggtagaatgtgaaaaggagtatggcttggagaatgttaccactggctgtcccagttaaaatagggagggtcccttaaaatgagctgagccagaatcttcctactgatggatgggatggttgtcctctctctcactggcaaaaggacaaacattttctgggtataataagggtttgggtataataagatgcacctcaggtttgaattccataaatccctcctgcagacataagagcagtttgtccagcctcagggttaaattgcctatgagggtcaggtctgcaaggaagtgtacaatgggcaacgggaggctggctgcagggatacggctcacacttaggtgtatagggatgcagtgggtattgttataatacaggttcttgttcagtaagtttggggtggtgcctaagactgcatttctaataaacacccaggccatgccaagatggccaggagctacagtaagataaaaataaataaataaataaataaaaacacatctcagccaggcatgatggctcacaactgtaaccccaacactttgggaggccaaggcagatggattgcttgaggccaggagtttgaaaccaacctgggcaacatagggagatcctgtctctacaaaaaaaaattttttttttaaattagctgggtgtggtcccacacctgccgtcctagctacttgggatgctgaggtgggaggattgctggagcctgagaaatggaggttgcagtgagccatgattgtgccactgcactccagcctgggtgtcagagcgagaccccagtctcaaaatttcaaaaaaagtaaaaaaataaaagcacacttccacatgtggcgtgcttcatccaagcatcacattaaataactcagcctctgggggtggatgttccttccccgtcctcttcccagctgtgtgaccttagcaaattacttatcctctaaactttgggtccctcacatataaaagtagggtaatgacagtgcccacctgctagggttgttataagaggataaaacacataaaggacttagcatggtgcctggcacgtagtacatactcaataaatggtagccgttgttcttattatagccgggcaaaaagtctgtgcgatctacgctttgaggaatgttacaagtaaatgccactttgttagcccagaatgaatgaaattcaattaaaatctctattggaacttctcaaagaacatcaaaggtgattctgttcatcacctgcagccaactcctgaaacttgtctctcatttccacactcctcatttctcccaccgcctccctctggtttaacatttatgtggtgcatgcacttagttcccctgactcccttgtttggcttttgttttgctttgtcggggtgtggaggggtgcttggctttattttgtgtctgcctcctcccctgattctttacaaccaggaggacccaggagcccacccagggtggaggttggttctcctctgcttgaacttggaagaacccaactcaagctgacacaatcaaaaaagggaatttttaggccaacataacttgaacctccaaggatcagtgggactggtgttgagtggctcaggacccagctcctcttcctctcctggctctgcctttctgaactggtatcatattctgcttctataagaatccccagctcacaaaccccagcccccaatacagacgaagagagtgtgcgggccctggagctcaattcaaaaggcccagaatgaaggcttgttggctctacttggtccaactcaggtcatgtgtccatccctgagccaatcccagaggccagagggtggaagccacttactggttcagcctaggccatgtgctccaccccagcctgggctggaaccagctacagcagaaccacaggcctatgaaaactgggaccttgcatatgaaaaccagaatgctgtcagagaggagaacggacactggacagttaaaaaccacacacatgtgtaatccactatgcgagaagtctctcgtccttggaaggctaggggaggagacgtagacaaagctctgcaggctgcagagtctcaggtccctgggctgagacgtcctggctgtgctcggtagggaatcactggcagtcaatgtatgatgagtctctgcatctcagagtctaggggtatattacatcccagaacactgcagcaattttttttttttttttttttttgagatggagtcttgttttgtggcccaggctggaatgcagtggcatgatcttggctcactgcaacctccacctcccgggttcaagcgattctcctgcctcagcttcctgagtagctgggattacaggcatgcaccaccacgcctggctaatttttgtatttttggtagagacgggctttcaccataatggccagactggtttcaaactcctgacctcgtgatccgtccgcctcaacctcccaaagtgctgggattataggcatgagccactgcgcccggcccactgcaggcctttaacgtgtcactcctgactcagctccccatgccatccaaccaaattcctctgcctgacatgtaaagttcttcatgacctcgctccatgcacccttctgctcccttggggtagcatcctttctccctgccaccccgcaggctcgccctcatccctgtgcctctgttccacagcccccaatcctagaagactcttcttccctccgcttatccaaatcctggtggaaatgactggtggaaatcctggtggaaatcgcgggcaagctggttctcctcccgactctcccaggagtcatgcaggcttccatgctgcaatcctccaacctcatgggtcagagggttccttgccagttggtgggatgctgctgcctgcctatgtcaaaaggagaggttgagagaatggagacgaagcatgtgaaagcttcggagagatgcctcgccaatgagaggaggccactgtatgctgaagggctgagcccaagtcctgcccacccccagcaggtttctctgattcctcagtgtccctggccctgcgtgcctctgggcctggtggtctccagctgtaacaagaccgaaagcacaacagagcgggaagggctgacagccaaccaggataacagaaagactcttttaaactgaaggcatttgagatgtggcagatgcacaaagggaccttttctgagcttcccttatctgacaaaaacagagattcccgagaagtcagctgccatcgcccccacttggggagtctccagacacgaaggcaactgacctttaacactgtgacattccaggaatactgtgtaaacgagctgtccccatcagctcaggctgccggaacaaaatgccatagaccaggtggcttaaatgacagacgtttatttctcccagttctggaggctggaagtctgtgagcagggcatcggcagggtcaggttctggtgagggctcacttcctggattacaggcagccgccttcttactatgtcctcacatggcagagagggagagacaacaggctctctggtgtctcttacaagggttctaatcccctctgagggccccgcctccatgacttcatcttgccctaatgacccctcaattgccctttatctaatcatcacactgggggttggggctccaatgcatgaatctgatagggaaacaaacattacatccatgacataagccttgtccaagcctttttttttttttttttttttttttgtgagacagagtctccttctgtcatcaggctggagtgcagtggtgcagtctcggctcactgcaacctccacctcccaggttcaagcaattctcctgcctcagcctcccaagtagccaggattacaggcacgtgccatcatgtccaactatttttttttttgtatttttagtagagacagggtttcagcatgttggccaggatggtctcgaattcctgatcttgtgatccacccacctctgcctcccaaagtgctgggattgcaggcgtgagccactgtgcccagcctgtccaagccttttatactttcccactgaagccctaaccctgccctccagccaccccatccctcccacccataaagctggtatataaatccttagccctggctgttcagagagctcctccttacagagtactcccgcatgcatgtgacataaacctgccttttctcctgttaacctgtttattcacagtcccccactacacgaccctaagttggtagaggaaaagttctcctcccaccagagccaggcaccatatgactgtgagcatggagttctcgtttccttaataaggttccggagaggacagagaatgtcttcagccctctctgtgcccacagacagcagcctcatcttcagatctccctttcctccgaacgtgcaagatcatgacctgcttccccgtcactggctcctctgatgggacctgtgttttcttttgcctaagtctcgtcccccagccagactagacttattgccagactggcccattcttttcatgcacctgacactctaacagaggctggggttgggggaaaataaatctagactttggccgggcacagtggctcacgcctgtcatctcagcaaatttggaggctgaggtgggctgatcaccggaggtcaggagttcaagaccagcctggccaacatggtgaaaccctgtctctactaaaaatacaaaaattagctggccatggtggtgggcccctctaatcccagctactcaggaggctgaggcaggagaattgcttgaacccgagaggcggaggttgcagtgagctgagatatcaccattacactccagcctagatgacagagcgagactccatctcaaaacaaaacaaaaaaataaataaattcagactccgtaaggagagactttatccaaaaggattattattgcaagggggtgagggtctaggggacactgcaatagggagaatactgtgaccaagagatctccaagtgtctcaagggcaggtttatgttgcatgcacatgggaatactctacaaggagtggctctctgaacagtcaggggtaaggatttatataccatctaaaaaaaagaggttttttttaacagaaaaaaaaaaaaacaaagctagaaagaatcagtgtggggaagtggatgaaaaggtagactgggtggacagtagacagagagagtgtttccacctgagtccagcctgttctcaggaggggtggtgtgctgagagtgggccaaagtgcaggggtctggagaaaggagagaagcagaaccaaagtttggctaagagccactttgttcccattgaccaatagggaccagcattctgctaatcacttatgaggccaagatcgagaatctgcaaggcctgtgcctgtccctgctgtacataggtaaacatgggaggcatccctgagtcttatctaagtcatgagaagaaagatgagtctttgcagcaaggtgttttccagaacaaagggtgaggggattcctgtaaccttggctcttctccaggaacaggggggctcaggtgaaattcagcatcgtcactggatacacacacacacatgcacacacaaatacagacaagaaagcctcatttttagagcttcctgtagttgctgttgtgtgtttttaatctacagacacaaatctgaatctctcaatgagggcagactgaacccttgtttaggggattaccctcttcacgggcctcttggttttgcaaagctggcacccacttccagcattaaaatgaagatactaagaagccagcaagtttgatatggagaacagatgctctgcatagcaatgaaaacttcctctgaaattatagctgctttaaaatataaaagtttcctctccccagggcacttcagaggattggaggcctggactctaggagggagacctggctcagacactcctggagcagggagcataaggttgaatcaaagccaaagttagggctgagatgagggaggaaggagggaaccccatggattccaggagtaggcaggccacctgtgttttcttttctgaactataattccctctgcctgcccaggcctttgggaagtctatgggtagtccagcctgtggggagctaaagggaggcacccagtggtgtcctgccaaatatttaacaactcgctctctgggagttggaaagtgggagaggaagatttctggtttgcagcatttgccaatttccgtggtgtcaatacaatcaccatagccaatttgaagctaccgagcttgagaaattcctgaaattcaacaatcagcactggtatactggtatcagccagctccagcaacgcgccagtgcgcctgttacacttagggcaaaaccacatggagcagcagtggacagaagcctggggaagctggttacaagtggccaaaggagcagagcaggctgggcgcggtggctcaagcccgtaatcccagcactttgggaggccgaggtgggcggatcacgaggtcaggagatcgagaccatcctggctaacaaggtgagaccctgtctctactaaaaatacaaaaaattagccaggcgtggtggcacatgccccagctactcaggaggctgaggcaggagaaccgcttgaactcaggaggcggaggttgcagtgaagccgagattgcgccactgcactccagcctgggtgacagagagagactgtctgagagaggaaaaaaaaaaaaaaaaaaaaaggagcagagcagcaggcaagctctgataactggctgggacggcctgatctgggaatgtagaagtattcctcaggggttcccaacaatctctgcactaaggaatctgtaacagattgggtttcctgtgctcaagtggaggctgggactctagtgttacttgggaagcacaggcattaagtcctagatcctgcgtggctgacatcagcctgttagagagtgccttgcgagaccccgacccttgggtttctccagtccgtccgtgttcactggctcctgaatcatgggaggtttggcggaaggcacctgagaatatgcgtctgtgggcaggcggagcagtgtacgggtttctcgtgcaggatgggcaccctctgggtagctcagtgtgactgttagagagggtgcctcagggtggggctcctccacgtctgtatacgtgtcaacacagacagctaaatgcaaacacctttaaccaaggccagaaattgccaccactttggttacttcccttgaccacatccactagctgggcaagatggagatgatgaaccaagaagttaagaggcctcgaaatgaaaagccattcatttaatgaagtcatttcctccccgccctccagggccatgccatgaataaatttgcaatcaacatctcaagggtgcaagaaatggtgcatgactttattttctttaagtcaaattcaatctgactgcaagccgcatcccatggggatggcaagaaacaatcccgttcaatgttggggctccctccccagggtcatattgaaggagagagacatccctgcaaagtaaaactcctggggagcctgtctgtggtctacactggtcctagatgtccagcagctcttcaacatctgtgctaggttaaggcttagactgtgttgagggggaaccctggtacctgccctccaccccactttccacaacccctacccactttccacaacccctgggcatctcaggggagccagctgcagaactcaggggtgggggccatccccttcctattctgggagaatctcttctttctccacttttatctctgtccctgcaaagcctcagccctctctcttcccaatctcagccacccagcaccacgtcctccgtgagccgatcctttcacaggagtcaggaggagtgagttggactttacagcttctacctcagccctgcaagttccctaagacaaacaggcagaacgactccctgggataggggagtggaaaatacaaagaaccaaacccagacagtgtgagccttccactccagtaaaaacaacacgccaattaacatcagtgttagcctgtcctgtgtgatcaggagaagaaagggagaaggttgtagggaagagagatggagccccatcctcagaactgtgggggtggaaagcagctggtgtggtgaccacaggtgtggcctgcccatgccggtgatggctcagcaatgtcatcagggttggatagcagcacacaaagggccagaggccgcgcagggaaggggaaggctggagtcataccttctcatacaacatttgcagactcagcttttttgaggttgattccctcctcagcataccaagccccatcccagggtccatggtctaaactgtaagactcggcccggcacagtggctcatgcctgtaatcccagcactttgggaggcagaggtgggtgcatcacctgaggtcaggagttcaagagcagcctggccaacatagtgaaaccccatctctactaaaaaaaaattaaaaaaaatacaaaaattagctgggcgtggtggcacgcacctgtaatcccagctactcgggaggctgaagcaggagaatcgcttgaacccgggaggcagaggttgcagtaagccgagatggcgctactgcactccagcctggctcaataaacaaacaaacagtgagactcgcctgcagacgtgactgtttttcctttccccctcctgcctccatcatcccgctggtccgctcccaccttcctctcctggcccatcccatgccctccccagctcctgttatgctcatctctaatgcactgttaaacactaagacaaatccactggtaaagccagagacaactgggtggctgtggctgccacctccctggtgaggccagtgttaccatatgagtctgacaacattcggaccccccccttctgaaaacgttcatagtccctgctcaaggcagggtgactgccaagacccacagcatactccacctttcatcctcccagcacccccagtagcagagacaggggaacgggatggaatatctggcttcatcttaaaccccaagtccattactcggcaagcctcgatactctttctctgttagagaaattcatggcactctagacctgcctagagagttccccaaggcccccatctctgcccagaagactccagcctcaaacacagaaaaataatagaccttccctagacaccgtgtcccaggtccaggtgtgccccagtcagcttgcggagactttggggctgagcctcaggctgggcaacgatgatgataaccactgaactaaccgtgtctgccctgtgcccagtgactcttcacagctgccctgtgcctggtcactcttcacagctgctctaagactgggagcatccgcatctcccactgaggaaaggaagcccagagaaatcacctctccaaatgcacacagttcatgagccttagacaaaacctcaggcatccaatgcccttttatattgcaactttgttacaggccaggaggagggaaatgtatcacccacacacccatgggtaattagcttggattcatttaccagattagacacctcagacaagagggagcagatagagccctgaacaaataacttttcagagcaggaaagccattgaagaagactaaatggtgggggagcaggctaggaagcacccccctccccgccgcccaccgccggcatagtgagggcccaggtgcagtgcagtatacaacctgcacagctgtgtgcagaacccgggagagtcggtgcgggtgtgataggctttgcttctgtccactggggcagcgcttctcacactcgaatgtgctgccggggcctgggggatgctgttaaaatgcagattctgattcagcagatctgggctggagattgagcatctgcatttctaataagcagccagatgatatggatgctggttgatggccacacaatgagcagcaaggtttggaggcagctccaatcttcatagggttaacctgccacatggagcagacagggtatctctgcctcctcagagtcccctcctgggccatcagcaggggctacaggtgcacggcctctgatggggatttaaatccccttactgggatgctgtgtgtgattggacctcgtcacatttgccactgcaattgctggcgccagagcagcttagggaaccagagggactgaggaaagtaatatcctcacagcccggggggtgtaaataatgaaagtcagatccataagtaattactttttaattaattaggaatgatgcatagcgaaggcccagcgactgtcgggtggagtgggtgttaactttaatagccttgttcctttccctgcccaaactgatttgctgggaaaggagacagagggaaaggatcaccctgggtttgggagaccgaggagagcaaggcaggaacagagggacagtcccctcccagggctgagccccaggaaccttggccaaggtcagggaattctccccaccccgttgaaatatcttgtccctggagaaagacacgggccatgcttctcacttccaaattctttacagacttacctaattaatcttcatgcacctcctggagggagagccaagtgctccttcctcttcactcagcagaagcagagctgctggccagggagggcctgctccaagccacaggtcgggtgggtgcacagtgggtggaggatacccttcccaaaggcacacctgggaggatgggagaaggagtcaggccaggtgacctcaggagggccgagggtccgtgcggtattcctctcacccagtgtcctaagcttagtaaacccaggccctgccccctgcccaccactaactcacgaataaagcctgaaagcagggccatttgggagcatccccccacccaccacatctggaagaaattacatcattcaaaggtgttaaaggcaccgagcattccagcctctccatttgtagaggaggcaatattggatctcaaaatatgaacaccattaggcatctacaaggggtcccggttcctctcctcccctcccccagcctctaacaacactgtggaccacccccgacttccctccagttcaaccagggaggccggcagggtaggtgggaaagggacagggtaaagatttccctatgcttttgaagaaaagctgggtaaactagggtaaggccagtgaagcatttgcctccaaatttaagggggcgcccccctaaaactcagcatatttgccaggtttgtctccccggcagatgcacttgccagggtcctcaattttagactcccagggaatccctgctaaagcaacaccttcccagaggcccaggtgagaactaagttttaagcagctttgaggaaggagagtaagccagatggggagagagaggaagtcagggaaaggaaaggaagcgaagagggctaatgctcgcttagtacctgccctgccaggccaggttctttgcacacccccaaggaagacatatttgcccccatttacagggtcaactcagtttccccacctgtgcagaatgggcctgagaaaaaaaaatccatgataaacaaaatgtccaaatgttaaataaagaccagacccagccctgccctcggcctcccgcctctcactctagtcctagccctatggtaccctgtctttattttaaaatttgcatatttttttcgttgtggattgaggagctttgaattttgattttaatattgtatatcttgattacctagtttttaaaaaatccccctcccaaatctagtgcccaaggggaatgccttactcacccaacccttggtcctgtttggaagccatacagggtagtgaaaaatgaacattaagaatcagacacaaaaccaagtccagctttgccatgacacctagccaagcctcaattcctcctccataaaaatgggctactagtgccactgcaggctgatggtgagacggttaacaaatgctgaccttggcacggagcctggcatagagcagaggctcagtaacatggcagctccctcctctgcccagtccttccacaccccagacccccactgcaaaggcaactatcagtcagggacccacagagcccacccaagctgggtggggaccaccagcttctcaaaaatccttcccgggtctgtctttggcaaagggagaaatgaactgcagattcagggtgagaagggaaaactgataattgcagctgtgtcaaaccaatttgtttgtgttaactgccgccaattaaacttcttttctttctttttttaagttttaagttaccccaggtcaggctatcttagggaagtggatttctggccagacggtaagaaatgcttttatctactctcacctgaggtggaaggagaaaaataaatttcagagacactcaggagcaatgaaaagatagaaaagagctggggaggatatgtcagagagaaatgagtgactaggacagcatgacaagcccagtccccatgagcagaggggaagagagacccaggccaccttcggctggctggctactcagtgtgtggtccatggaagagctgcacgggcatcacctggggagcttgtaagaaatgcagcatctcacgccccaccccaagcccctcagtcagaatctgaattttagcaagactcctggggggatttgtatccacagtacaggtttgagagatgctggtctatcccactctgagacccacccatcctgtattgatcttccccaggcaccaacggtggaggctccttagggcatggagtcttctgggtcaccccacccatttctaaagcatctggccattcaccaagaaaggtcctctcaatggttccatatcttctgatgcaactccattccccagcagatcagtcctccactcaccgctctgctggggcttcaggaactgtcctgtggtgtctggttggatccagccgatgggaggcaggaagagagaaatgctggggaatgtattcctgactctctccctaaagggcttcaaactgaagccccttcaattgctctgctcttctccttctgctcacatctgctgggcacccccctccaaggctaagctctatgctgagctctattaacctggctccctcctcttgcctggtcaggcctaagaggcacagcggcttcctggctactgtttagcagatgcatctgatgggaataacttgatcacacctcaagaatgagcccgtatggcaggtgcacctgaatgcacgctctgaattccgagctaaggaatccatgaggggccaacccagagagtcattccttatctatgaggaacatctgagcccccagccagtctgtggaacacaggccatacaggggatcaaggcccatggttttgggttaagtgaaggtgcccaggtggagatggttaggggagggtgctaagtaaaaatgccatgtaaactgcatgcttttgtaaccagtgatggttctcccacccagcccacagccacggagctgtgcttcatcctgttgggctcactgccgctgaaccctcccctgcatgtaagcccccagcaaagccccatgtctcatctgctggctctgggtctcttctttggtctcctgaacctggtgccatccccattggaattaatagggattcagcacaacagctactccctggatgtctcattctcctcgtttccctcagccctgctgtcgaatgggttttactacttaggtgctgcaaggtcaaccgatcagcagacaactgccattgaaaaggctgtctatggtactcacaggggccacacggaaaggcaacaggcttggttttgagacagaggaaggcgacaaccatgggcaagagccttcactgtggttccttgggatgaaatgagcaaggcacagtgggcaggtgtagcattggtgagtgtgagtaatttcagcggactctgaggcatcggagccatccctagatgtctggcacccagccctggggtgtttagtgcaggcagatgtggtcagagtgtgagagcccagcaagggatggaattgagggcgtagactctggatcagttggtttgtatttgaaaggttcatatactgcctcccaagaagattcctcccgaggaagtgggtgcgggagggaaagaggaatgcaggagtctgaagcaagaggattctggcaatggctgggcgcggtggctcacacctgtaatcccagcgctttgggaggctgaggtgggcggatcatgaggtcaggagttcaagaccatcctggccaacatggtgaaacctcatctctactaaaaacacaaaaaaattagctgggtgtggtggtgcatgcctgtagtcccagctactcaggaggctgaggcaggagaatcatttgaacccaggaggcagaggttgcagtgagccgagatcgtgccactgcactccaccctggagacagagctagactccgtctcaaaaaaaaaacaaaaaaaacaaaaaaaacgactcgagcatcatccagttgctcagacatgtgcagcctatgggtgcagggctgatattaaagcactaagtgtagagaagctaggacatggctaatatgcctccctagacttctaaaatcatcctcttactaaacttttctgttaagcctttgaatgtgccagctgcttcctgcagggccctcactaaatcaaaaggcagcctatgcttacctttgaccctgttctctcctccccaagagtgtacctggattttcttcacctgggccctgggcttggtcattaactacacctgaaacagaactcgagtctctctagaataagcttttagatatgcaagcagatctaatagatattttcataggcgatttcccacctccaatacatacacaaagtgaccctggaagtattttttttctttttttggttgagatggattcttgctctgtagcccaggctggagtgcagtgttgccatctcagctcactgcaacctcagcctcccgaatttaagcaactctcctgtctcagccttccgagtagctgggattacaggtgcgtaccaccacacccagctaagttttatatttttagtagagacagagtttcatcatgttggccgggctggtctcaaactcctggcctcaagtgatccacccacctcggcctcccaaagttctgggattataggcgtgagccaccacacctggccgaccctggaagtcttatatacagctatgcacaggaaagcaggagcaagatcttctttctagtaaaaggcaagaggtcagaataggaacatcaagtcttctctgatcccccgagaaagcgggtcatcgtccctcctctgcctcccgtccatgcctgaactctgtgaccgagggcaggagtcaagaatgtgctgtgcatgctccttggagctcagaggcaatgatgatcagattcaataattattagtgatctgcatattctctacggcagatgaaataactgtacagaagagcgggcggaagggagaaaaccgtaaatgcctttctctttcagcattaaaacagcaacgctataaagcttgctgcaattaattagcactcttattagcacctttatctacccatccccacacagtgtaaatgccagagagcatcaggcagctctgagcccaggggcctgggcagggctcgggagggaggggccttcctgagttcccacgctaggggctgggaggatgtgtgtgtgttgcctagagatagctgcacctccatagaccagaagactgaatctcctgggcactgagccagtgggagtaacccagggaatcttgtgtgtgcaaagaaatgccaactgccaagtagccagggagaaagagtgacacacacacacacacacacacacacacctcctaaagtatccacgctccaagactcattgcccaggccggcttcctgatcatgtgaccaatgcagtgtcacccagggtctgcagtcagagggggccccatgcttggagtttgatcctctgaagtcaccttcttaaaacttgataattttatctttaaggccgggcacggtggctcacacctgtaatcccagcactttgaaaggctgaggcgagcagatcacctggggtcaggagttcgagaccggcctggccaacatggcaaaaccctgtctctactaaaaatacaaaaattagccaggcatggtggcgcgtgcctgtaatcccagctgctaaggaggctgaggcaggagaatagcttgagtgcgggaggcagaggttgcagtgagctgagattgtgccactgcacaccagcctgggcaacaagaacgaaactccgcctcaaaaaaaaatttttttaaaaaaggccgggcgcggtggcttacgcctgtaatcccagcactttgggaggccgaggcgggcggatcacaaggtcaggagatcgagaccatcctggctaacatggtgaaaacccgtctctactaaaaaatacaaaaacaaaaaaaaagccaggcgtggtggcgggtgcctgtagccccagctactcgggagtctaaggcaggtgaatggcatgaacctgggaggcggaggttgcagtgagccgagatcttgccattgcactccagcctgggcaacagattgagactctgtctcaaaaaaaaaaaaaaaaaccaaacaaaataaaaactatctatctatctatctttgaactcgtgattagtaagcgaagtcaatgggacagtggagcattcttgggggcttggggcccctgggtgggggcccctccctctgtttccacacctccctgggatgattctcagctgctaactccacctcctccagcaactgctgctgccctgccatccccctgtggcaaactggggtgccagagggtcattgcggaggtgtgtaccccatggaccaaattgtgaagtggggccccaagcatctgtgggcatctgcagtcaccccacagatatccccatactgaaggagggaaacttacaacaaatataaacatcatgatgggtagaagagaaagacagtaagagaaaggaacaagctttttttttcctttttgagtaaggatccctacattttcattttatttatcttttatttttgtttttttgttttgttttgtttgttggtttttattgagaccaagtctcactctattgcccaggctggaatgcagtggcccaatctcagcttactgcaacctctgcctcccaggttcaagcgattctcccgccttagcctcccaggtagctgggacttcaggcgtgtgccatcatgcccagctaatttttttatttttttttagtagagtcagggtttcactatgttggccaggctggtctcaaattcctgacctcaagtgatcctcccacctcggcctcctaaagtcctgggattacaggcgtgagccaccacacccggccccattttaaattgggctctaccaactatgtagctgagcctgcccactgctttcagggcaggtttgggggtgcttcacagggctcccccagccctctgatcagctgtgactactacgttcaatcatttgacagacacatcgaaccctgctatgtgcaaggctctggatgaggtgatatgggggatggagggatggaagtcacatacccctgaaaaaaccacaacctcagggctcgattgctccctctctgcaactgtgcatgtgtttttaaataataaatgtagagaaagagatactcatgccaatgtctcaagcctaagccctggctgacatctacttagctggggaggtgaggagagagtgacccagtgggggcaacttggtagcagttcagacccagcaggatcagcctggtccttaagtgtagagtagttcagtggtgctgccctgaggtggttaaatataaaagagctaaatcagagctagttaagttcctggttctgctacttactatgtaacttttcgagtttattaaagtctcagcttttacttttctctgcccttgaatcaagcaaacaaaaaatgtggattaaacaacatagaatgggccgggcatggtggcttatgcctgtcatcccagtactttgggaggctgaggcaggcagatcacctgaggtcaggagttcgagaccagcctggccaacatggcgaaaccccttctctactgaaaatataaaaattagcctgttgtggtggcaggagcctgtaatcccagctactcaggaagctgcaccaggaaaatggcttgaacccaggaggtagaggttgcattgagctgagatcacaccactgcacttcagcctgggcgacagagggagattctgtctcaaaaaaaaaaaaaaaaaaaaatgtagaatgtccattagcaggtgtgcagaagcaggaagagtgagggatgaggagaagccaacagagagtgcatcaaatagcatccctgctgtggcaactgacctcagttctgctggggaaccaggcagcatgggcctcggaatcgccccccagaagatcaggaggctgagacattcatccaccacctcccacccccaaggatgtcagctcccctgcatttctgggctgccatgcactccaggtggcaaccccagcagctggaggaaaaatccagaatataaaaggaaagcacgcgatggtgccagccgtgggagcttgtgagtgtacctggacactgcccaccacagctagggctgaaattccaagtcagctggaggatatgacacaggacaccaaaccatctgcttccaaggcccagctatgacagggagctggccggcgggtggggcccaggcctcctcagggtggttacatacaacaggatggaggcgagaggttgcagcagggcaggcaagagccagcactcaccagtggagaggaggagcccacgcctgtcctagagcgagccccggcaccaactccagcaacatcatcctcaggttttccagagcctggtgttcaggcccctccttggaacacctgtggggactgggagggcagcccagcaaggccccactgatcaacgcggagacttccctgctgggtctagttgattttcacccagctttctgggagtagagctgttcccagagcttccctaagcttgtgcccagatggcaaatcatgatcctgcgaaacagaaggagaaatggtgcgcacatgtgagcaggtgaatggatgcggggccgaggagccttgcctgagtgcaggacggctgggctccaccctcagctctgcccccaccacgctgtgtgatgtcccaagagcttgtgacaagagctaacactgattgagcactcactctttgccaggcactaccctgggcgccttacaagggcgaatccatttaatctctgcatcgtctctacccccactttacagattagcagcctgcagaatagagacgttaattggtttgcctaaggggacagctgggatccagagccctgtctgatgcaaaggcacattcttctctgtaaaatgggcccaaagacctctgctctgataactgcactgggctttggcctttagtgaaatcagcaagtggaaagtgattggaaaggagaacgcagaccacaccacacaggcaaagaaccacagtgtgtgctgacaatggagttccgcctgagcagaaagagaatggaaagcgagaaatggaagacaaacctcagcagacttccaggcattgggttcctggcttgctcctccaccaccagctactgtcaccaccctaagtctaagagtccatcacctcccattctcaccccaggggagatggaaccagtgggcacagctggtggagaagggcactgatggtgagtacagcccatcagaaggcattccccgggggatccacagccacattccccaggcttctgaaccaggacgccccagaagttacagtatgtggcttgtacgctgacgacagtggtgatacaatgacaacaggcctgcagacatccacggctctcctgcctgcccagccctggaagccagcctcagagccggctcattcagaatggccatgccctcctaggagaaacaccttcctctctctgtccctgcatggggtaaaaggatccaaaccccctaacaaagatagttcctgggcctggctgcacccaagccctagccaaacccagaggccgcccgggaccattttttaattcttttgcaatcagcactttcctttcttcatttgctggttgaataatgcagcctgtaagaaaagggccctcagcacaattctggtgctcgtttacaatggaaattgggaaaacggcgaaacgcgtactgcaaaatgcatttaaaagaagatgattcaattggatttggcagctccgatattcaggaccagaaggagaaaatctgtctatgatttgaacatgtataattaagaagaaagccttaagtaccgggtgcatttcttaagatgtcaccggctctgttgactccaggcgttttgatcagtggtgtagagcatttatttctgaaatctgaatagctatgagtgaggcgcctttttaaaaccagcactatggagccaagccctgacatggcacagctcgtcaaatggggtgaaggtagaaggagcaaggagggagagcaaaggcccctctggacccagctctgatcctcccccagggtgtacccccaaaccttgcagaccgaggttcaggcaaaattagatccatttggtgtgtcctattttggttcttctgctgctgccaatggaagtgccagcgccctgggaaccgttccatcctgaaaacagagagcttgctttgaatgttggaaatgttttaaaaaggcaactagtattgtggaaaaagccatgcagtggttaccagaggaaggaggctcaaaccccatctccaccctggctaattgtgggagcttgggcaggttacttagcctcccccagtctcagcatcctcatctctaaaatggtctaagtaatagactctccctcataagacagaacaattagacgaggttatccgtacaaatcccagtatctgacacgtgagcagtgcccactgtacgtgatttatcgttcttattattctcttcagccctctctcaagccacccaaaataactgcatgagcccaactcagctcactctctgggccctccgagagtctgcgtggaaagcaggatgtcatgaaaaacctcacttgcagtgcgagatgactcagtgagggagttgctggcagcccaaagccttctccatggagagctggaggcttcgcaggaatgactcacaggtggcacagtgggacagaaacctgaggctgagatgagtcacatgacaatagctgtcatatggcttgttggctcatcatcctaagcaggactggaatcttctgagatttctagggtcccctctcttttctctttcagatggggagaggaaagagaaggatgagaaactggtgtgagccctggatgttcttcttagaggcctggcctactccaggtagaatgtggccagactgtgtttgacaaagccaccccttccctccactccctaagctgcccgcacttttcttggggaggggaggcagggaggaaggatggggggaagtccaggggaggaaaaggaagaatctttcatgcaggaaatagttgcaggtttcataaccacacattcaggacacacctgttgcaagactaaggaggaactgatgctcagtactcccatgatgtccagcggatgggaggctaacctggctggtgtgggtcccacaatgccagagctgttggccaaccaccaggctcaccaagcaagaagaccctgcaacaggaatcagaagtcaaagagcacccagccatggacaaatgggtgataccaggagggtcccagaggtcacagcctgctggcaggctctagggttcccaatgacctccatcagatatggggggcatcacctggccttcagcaatggactgctccaaggcccctgagtgaccacactccctggggctctggccagtacctctctacacatacaggcagcccaccctgtagatgtacccagccctgattcccaaggccagcagcacggcaccgtgtgacccaaagattctagccacctggttcctagtgagaagccacagccccaagtggtctgctcatgtatcagggaagaactccttgccagcaagagttacagctggaaacatcaggcacagtctcaggccagttctgcacaggtggggaaactgaggctggccttggctcagcagagagctaaggcacagtgagaatccaacactaccgtcatgcctagttctggaccagaccatcgggccacgctgcctgcctggatgccagggtgttggagttaatgtagatggcttcaagtcctccagctctaccccttgccagctgtgcagcctttggaaagttacttagtttctctttgcttctgtttcatcacctgtaaatggggccaaagtgctttcctcagaggtgtgccaagaatctggcctggcagagcaggtactaagtaaatattcactttctttcttcttctttttttttttttttttttttttgagatggagtcttactctgtcgtccaggctggagtgtagttgcacaatcttggttcactgcaacctctgcctcccaggttcaagtgattctcctgcctcagcctcctgagtagttgagattacaggcacgtcccaccatgcccagctaatttttttgtatttttagtagagacggggtttcaccatgttagccaggatggtcttgatctcctgacctcatgatccgcctgtctcagcctcccaaagtgctggaattgcaggtgccaccatgcccggccccccttttattttctgagtttttcactggtcccatctgcttccctctccttcctcaaagctgcttaaagctcagcaacagccctgcctctgagatggctcagcctttagtgccacgcatgctcagtgatacccccgtgagtctgacggtgaggacttcggcaattgcatctgacctggaggtaaagcccagaaatataggcaaggaaatgctctgtgaatattaaggaaggtccaataacttcatcccctaaaagacgtaagaagaggcccttgggtttgccacttgactgggactcacatctctgcccccttttggctgggaatgagtatgtggccagtctggtccatgagacccaaggaatctgttgaaagtctacagaaatgaactgtcctgcctcatttaaaagagcgagggagagagtgagagaagggaggcaaggggcagcccttgctgcccctggctatctgtgcacatggatgggtgaagacagaggcttggggctgctgccgccatcttttttttttttttttgagacggatctcgctctgtcgcccaggctggagtggcacgatctcggctcactgcaacctccacctcccaggttcaagcaattctttgcctcagcctcccaaatagctgggattacaggcacatgccaccatgtctggctagtttttgtattttcagcagagatggggtttcaccatcttggccaggctggtctcaaactcttgacctcatgatccacctgcctcagcctcccaaagtgctgggattacaggtgtgagccaccgcacctggcttgttgctatcttttaatgcaaagggaagactgagaaaactgcaaagaggccggccagagccctggcatcaccacactgctgaagccaccccagagcactcgcctccagagtcttgtgtgaggaaataaatgatttaagtccgttctagctgtatgttgttacttgcagcagagcacaccccctttccaagccctaacgggcacagctatcaagtcaagagaggaatactgccagcgttggaaggttgccatgagaaggttcacatgacacctgtgaattgtgcagcagtgtgcagcatgcaaaggacgcccacaacacgtggcccctcttctctttagccaaacctaaacttcatgcctccaaaaccaactagtcctatgaggcaaaaagggctctttccggagcccagcccaggcgccgaggcagccacccagtggctgggatttagaagaagcctcactgactcagcagcaacagagcttctgcctccaggctccgaatgccactgcctgcccagaggcccagggagaccgagagcaaacaaatgagctcttcgaatggcagcgaaagtgtcaaggaagtcaaccgcagaggccatgaacatctgacccctccagaaagtgctggtgtggagaaatgctagtgcagcttcattttcagcctctgatttcattaataagataatgatgagccatttaactttgcatctgaagagtgaagcaaattacctgtgtctacattgcttaatgacggaggcactaacaggacctttgccgcctgctggaaccgaaactgacctattgcaggaggcaattttatgctcttgggtttgccacttgactgaagccattcatcaggccgggaactcaccaccctccccaacacacactccacattagctccgtgtcctctgctgcacgctgcccctctccctaacggacgcaggcttttttaacccaatgatcctgctaccattagttatttcccggacatgaaccactgggccctcattagccaactctcaggtatccaggtgtgaattttccactttggcaatgtttccccggagaagtattcatctgagccaagccatgtcctggactccatcttcccatcagcaggaaataccaacaccgcccgtggccttctgagccaaagatgatgagagaaatcaagacgcagccaaccacagaagtcttccaaaggccagagaggctcttttggatttttcattgtttcaggtccatagattttttcatttcttttaattaaagtagaagttccatacagtaaaactcacgctttctaaaagggaatggctccgagagttttcacaagtgcatacagttgtgtggccaccaagacaggcaagacacagaacagttctgtcaccccagagagttgccttgcaccttctatggtcaacctctcctcccactcccagcccctggccaccactgatctgttttctttccctatagtttggcctttgccatcatgtcatatacactgggaagccctttgattccagcgtctttcacttaatcacctgcatttaagatggatccaggcacttttgtgcatcagtagttggttctgttttggtgctgagtagaagttcactgtatgggccgggtgtggtggatcacgcctgtaatctcaacactttgggaagccaaggcgggcggataacttgaggtcaggagttcgagaccagcctggccaacatggtgaaaccccctctctactaaaaatacaaaaaattagctgggcatggtggtgggcacctgtaatcccagctactcgggaggctgaggcaggagaatcgcttgaacttgggaggcagaggttgcagtgagccgagatcacaccattgcactccagcctgggtgacaagagtgaaacaccatctcaaaaaaaaaagaagttcactgtatagacaaaccacaagctatggatgaggcccaagggtgttcactgagcacccacctaccctgagccaggtacttgaacatacattatttcaattaatctgcaggaaaaactgtgaggtaagtactcctttttttttttttttttgagatggagttttgctcttgtcgcccaggctggagtgcaatggcatgatctcggctcactgaaacctccgcctcccaggttcaagtgatcctcttgcctcagcctcctgagtagctgggatgccaggcatgcgccaccatgcccagttaattttttgtatttttagtagagacggggtttcaccatgttggtcagactggtcttgaactcccagcctctggtgatctgccggcctcagcctcccaaagtgctgggattacgggcatgagccaccacacccagccagtaggtactcctctatctccattttggaggtaagaatagggccatgcagctagaaaaagaagggatgggccagggacagccacgagcaccatggagaggccatccactccatcattcattcgttggacaagcatctcctggagccctttcgcaggacagggcacagtgctgggtgcaatggggaagcacatacagccctgcacagagggggttacagtcgaggactgtgcttccacctgccctgcagggtgagcccactggactttcttgtacctgaggctgaagacgccacatttggtgagtgtgtggcccacataaggtgatcctcctggtatgtgtagggagagaaaagactcagccttctgtaagaccctggggaatcggcagcaggaagcgcaagaaaggcgatcggagacgtgttttctcagcacatttgtgctctgaaaacaatgaaattgcaggtttcactagacagacatgccagccactgcctgcaagtaaatatagcgatccctgaggcttgctgccctccaacaccaagtctctgtcgtttggacttgggccacaaaaccacagagaggatggtggggggagtagcaggggtcgggaggaggaagtggtctaggcatcacttcctggctttttccatccctgttccaggcacatggccctgaggctcaccaacctgctggggaagatggcacccacttcatggcctgccattatcagccatacacacgcctggggtcatcctctgaccgatacagtgtaagcaacaatttgctggatgtatagatttccagggggaagaggcagcagtggctgttgtcccacagctctgcctaggggtgtgggctccagcgtttttggcctagatcataagagggaatccctaaatagaggctttcagggtggggatggagaaggctctggctcatttcctcctgagaggcccccggtagagcagtccactgggcttctgaaggctcctcaggaaagtgcacagtttgtatttgttctcagctcctagccaagtgcctggtttaataagcagcttttgagcaataatgaatgaatgaaaggaagaagggaaagagaaagacaaggagagagggggagagggagggagagaaagagaaacccctagaggcaatcctttctgagtttcttagtaaacagagaaaaatcttaagcttaccagctggagaagagcaggaatttggggttccagtgccgaacccccattctaccacctgttagctgcacaagttactttacttttcatagactcggtttccttgtctatacgacaaggatatggatacttctctctcagggtctgggggaggattacatgagatcattttagacctcagcctaatgcccggcatggaataaccgccaatcaaaagtagctattgctgctgctcttctgactttagcaaaagaggcctcctggttctggcctgaaagcagggcaggccatgccgtggccgggaccccctggtgagaatggaccctcttggagactctgacttcattcctgcccaagctgcaggacagctgtccctgctggcagctccatgtgcatctggaactctctgagcaccaggctttgtgtgtgtctggattaattgctttctccacccccgcatctctgcccacctgcaagtgggaggctgaggtgactggggacctgcaggttttggtggagcccctggcccctcaggcctgagcttgaggagagatggagaaggactttattaagatggatgtcagagctccagtcggccctcatcctgcagcttacgctaaattattaaacgtcggcaaggacgccaggggctttgccatttgttaacagatggctctcaactgaatctctgtgcatcatcttgatgtgatatgtacaggggattgggcacagcccggggatgcagcactggaggaggaaaaggcattgcggacccccgtggagactgcccaccttgtccctgcaagctcctgtcgggttcactcacctgtgtcagttttgcttcttgtccccctgctaaggggctctctgagtccagcggggcaccagacctgcccagagcagcaactgtaataattaatgttgcatgagggtctacttggtgctcagcatttccctcgcatttcttatttaatctccacagtgagcctgcaagggaggtgtcattcacatccctttataaatgagcacgtgggacccagagtggcttattgcccagtgttgcacactcactaagtgacagagccagggctaagatccatgtccctctgacatctccagcctaacctctccactgtgctgccccctgggcccctggccaccgactctgaaaccctccccagctccccttggcctgagagtgcccagggagaatcaccactggcgacttcctatgctcacatcctccctggaggcccaaaaagggaggaacagggaagaaaatgctggaacgagctcagccctcctctctggacatcccccgcttcatgtgggtaggacccagaggatgacaacgggctgcttgccaggattcgtttgctgtggtgaggcagctgtcacggtccctgccctctgccctgtccacgggtctcccgaagaggtgtccagcctgccctgtcattattatttattgtaattgctgcattttattgagcaccaagtctctggcgggcagtaggtataatgtgatcacatttaaatcattgttaaaagctttgtcataaggacagtcagtcagtgagaaaatctgatcacagcaatttggaggcccctaagactcaggaccaggaggggatccttgattttatactttgcaactgaatggaactaactgtctcagaaactccaggtagcaggtggctgactttcagatcttccaagagcctcgcgtgcccattttaatggagggacagctcgagtccagtttccccagcctgaggaggctctgtaggcaagacgcgtgtcatacatgcccatctactcacatcgagtctctcctgagtttactgcagccacaaagccctcgaaggctccatacactgaccctgaccctccctgtgacccaaggccttggcagataaggagaaggccagcaggtttctgcaagacgcctctgccctccccacctgtctcctcggagccccatctccacctctctcaggtacaatcatttctctgaagaaccttctggctctggggaagtggctgaaagcctccctggtcagcaattctcactccttctctggcttcccactctctcctctttcatcctgatcttctcattggaaactcacatcccacctgggcaaaatgaacccctgccaggcctttacccctgcaaggaggggaggctccccagggccacatcccctccccttctcccacctgcccacgggcgcttccagaaggaaccatctttaatgggtgccctcacgtcccttccaaccaccaaagggggaaaatatccttaaagcagttgcttattaacagcatctggtggcattcgcagcccaggacgtggcaaaatatagatcagagttgggaaagccgggaatcacgctgccatttgtcctattccaaatgtcattttgcgttccatcgcagcatattaccgagatgattagtggcatcaaatgacttctgaaaaatgattatgtgccattaaaaccattagtctgtccgaaaccagcacaaacaaatggcaatgggaggatgagtcattagctggggaggctgggtgacgagtagagagctgccctgtgctgggcaattagtgaggccaacaggttggagcagccaggggggttggtggagcccagagttctgcccgggctggggaagccctagggccccgcgagagcaaagggcctgtggggttcacgcttctcccagggagcatggatttgggtttgcttggagggccctgccctccccacaggctgagggcagagacatcacagccttccccagtggaggaacaggaaaatgaggctggtgcacctgcaggttactggaaacaagatgtgggaaaaaacagaggcagggccgggacatcactgcaggggtgtaggatgagcaggcagaactccaccgcagaggcccctggggggaattttttaattgactccagcaaaaaatgacaacaacaacaaaaattggcttgggaatcacaatgtaatttacgacaacaagaacacttagagaagctataatttcagagattaaaaaacattttttgaacatatactaacaaaatagctttgatgtgacagcgaaagaaaaaaaaacaagtaaaatgtttgtcatttttttttttttttgaggcagggtctcgccctgtcgcccaggctggagtgccatggcatgatcacagctcactgctaccttgaagtcctggggctcaaatgaccctcccacctcagcctcaagagcagctgggaccacaggcacgcgccaccacacctggataatttttgttttttttggaagagacatagtgaagggtctcactatgttggccaggctggtcttgaactcctggactcaagcaatcctcccacctctgcctcccaaagtgctgggattacaggcctgaggcaccacgcccagcctgagttgttgttttcgagcttgtaaaactagctgagctctgacaccaacccttggggtacccatggtgttccatgttgaattccacttgttggggcaaagatttggtttttaggagatggaaggagggaggtccccttgtcagccctccttgtcctcctcctcctccatcttcacttgtgtctaggcccactcggtggggccacatccctgcaggggccacctcaaagcttcctgggcatattctactgctggtcacgttctagaagtagtaagcaccaccccgctttatctcttcttccctgctcccctcccgtctttctttccatacattcaacgatgtgtgtggacagcctgctctccggcttgccgggtgtgcaagctcagcccagcactggccagccctgccctccagaaaggcatcatttaatcagaaagccagtaacacggacagtgggcttcatttccatgcaccaggcactgctgtcattcaccctcacctgtgaggcaggtaggattctcatctgcatttcacagatgggtaaacaggcctggagaagctcagtgctgatgctgcagacccctgagcgacaggaacccgggctgggacctgcctggttccccgcagtccttgcataatcctgatctcccttccccagggcaccggagagagagagaagcagtgatctatcagaagtccttccgagacttgcgcattgcgttccagtgccgggccagggaaccctgcaaactctgataaccacctctccatggctgtcgaggggtgccagcatgaccccacttacagggattccaagcgccctctgttgttcctggtggagagatcccgggagccctggtgagggacaggctagggtgttgcagtatggttttgtatcctcgtttggagagtctttagcgatcactgaggccccaggctcagccgtgcagactccaagccagtggtcctcagcccaaagcatgagaatgttctgggaaccttttaacagtagcaatgctgggaccccagccctgccaggttgaagaaccaccagtctgtcccacccctgcctgttacagataaggaaataagaggcttgcagaggagcggcaaccagcccgggagcaaacagctgctccgagctaaagcagatcaagaacccgaggcctccgaaaagcagcttcccatcctcctgccttccctctctcgctcccacctgccactccaaggtagcagagctgcagcagcttgacctggagaccgtccgccctgattgacaccagtcacaaccctggctgctccgagagcctctgaggcccagccccatgacagcccgcacctctgattgttgctgcctttccatctccagagccagaagaggccaccatctcaaaacggtggtggaactccaggagcccatcatcttgctctcccctcgggcctcactgggaatgacgggctcattccagagcagctcacacatgctgttcttcatctttattgaatttggctttgcggttcttgctgctttgaggggagggatggctatgacagcagcttggaagtgctgggctgaaatcattttccaccccccggcccacccgttctattagaaaaacatgaaatctcttccttccctttatttattttatgtgtttccttcttgctaagacagagagcaaagtgatgttgaacgaaggctgttagcgtcccagccacacacgtaatgaatgcttatgaggttagtttgctgaagtacatgtccagctgctaagaaagatccaacgtagccatttgtgtgaccctggcttccagacctggctgcctttacctactcctttttgactcgaaaaattagtaagatacgtaacagcctggaagttcttcaaggtgtctaacttcagtctctcctactgcagttcagtctttttgagtcaaaccaacacacattctccctgcaaaggctgatgatgcgcaagaatattaccagccatctctcttccagcaataattagtcacaagcagccccctacttggtttgggacactgatttcaaggcctgccatctgggaaatgctgagacagcatctggggtgcccagcagctcaaagcactctgtaaacatgttgacactttctccttgtctacgaaactttcctcaagaacagcccaaggacatgcatggacacagttggaacaatcagatcccacaacctccatacagactctcccgtggctctcaaacgctggggtacatcagaatcaccactgactcagtggctgttacgaactgaatgtgtgtgtcccccccccagattcatatgttgcatcctggcccccagtgtgctggtatttggaggtggagtttttggggggataatgagttaaagtcatgaaagccaggccctcataacgagatcagtgctctcataagataaaccagagaacctgctctccctctttctctctctccctgtctccctttgtttccctctttctccctttccctctttttccctctttctctgtctcactctctccctctttctccctctccctctttctctccttttctctcactctccctctttctctctccctcccctttctctctctccttctgtctccgtctttctccctttccctttctccctctctctccctttctctctctccctctttctctctctctctctccctctttcttttttttttggatgggaaggagtctcattctgtcacccaggctggagtgcagtggcacgatctcggctcactgcagccttggcctcccgggttcaagtgattctcctgcttcagcctcctgagaagctgggattacaggcatgcaccaccatgcccggctaatgtttgtgtttttatatatgtgtatacatatatattcttttttgtagagatggggtttcactatgttgcccaggctggtctcgaactcctgagctcaggcaatctgtcctcctcagcctcccaaagtgctgggattacagccatgagccaccacgcccggcctctccccctctctttctcttcctctctctctgtccctctctctctctccttatttctctctccccttctttttccccttctctctctctctccctccccatcccaccccaccccaccatgtgaggacatattgagaaggcagccctctacaaccttggaagagagcatccccaacccccgaccatgctggctccctgatctcaggctttcagcctccagaacaatgagaaaatcaatgcctgttgtttaagccccagtctgtggtctgtagttacagcagccctagctggctgagacagcaggtctggggtgagcctggggatctgtggttgctggcaagaccccaggagacactgatgctgatgcgattggcccatggactgaccacactgcgaaacacggatccagactccccaaatagggaccctcgtcttgagttggctgctgtgtgcctgagacattaggccaaggggaggagccttccaagtggaatctgaagagctcgcagactttggagtgtgacagacctgggccgaatgctgccctgtgacttcccagcagtcacttaccatgctgcctttcccatctgttaaaggggcatgaagacacctccctccaaggctggcaccggatgggatattgcatgggcacagtgcctcgtgcagtgacgacactgtttcagggtaggtttgcttgtctgttgttttggggctgagaggagggagacgggagaaggtggtcttcaggagcttggggccatattgcctaggtgcttccatcacccgcttcctgatcctggaagccctacagtccccacacgtcatcccttacatcagttcttcagtggaaccatccagaggcacaggcacctgccccttctgcagagtctcccctgaccacccagcaactgggagacaggcacaaagcatggggaagggggtgtgaactgcaactgggcaaaacccaggagagagaccctgttcatcaaggggttcacctgcctccagcccccatacagaggggaaaagcaaagaaaggcatcctcggacagctgggcattcagaaagactggccaagatatctgtcctgtgggtaagaggagaaggaggtgcaaagatctctagtatgcctcctggagggtgagctcagtgcagaccgcaggacagcctgggctctatgaagacagggccttggaccaaggctttggtacatgtggtgtattggttacctgttgctatggaatatggcttggatgttttgtcccctccaagtttcatcttaaaatgtaatccccatgttggaagctgggccttgtgggggtatttaggtcatgggagtgggtccctcatgaatgccttggtgccctccctatggcaatgcgtgagttcttgctctgctgattcactggagagctggctgtttaaaagaacctggctccctctcctctctcttgttcctgttcttgccatgtaacatgctggctccctgtcaccttccgctgtgattgtaagcttcttgaggccacaccagaagccaagcagatattggcaccatgcttctcatattgcctgcagaaccataagccaattaaacctcttttcttaataaactactcagcctcgggtattcctttgtagcaacacaaatggcctaatacactgtttgacaagttaccacacagttaatggcttaaaacaacacatcattttgatctcacagtttttgtgggccagcagccaaggcatggctcatctcggtcctctgtctcagggtctctcacaaagctgcagtcaaagtatcagctggggctggggtctcatctgaaggttcaagtagggaaggacccacatccaagctcacatgattattggcaggattcagctgcttgagggttgttagaataaaggtcccagctcctggccatgtgggcatcttcagtatggcagcctgagtcatcaaagcctgccagccaagaaggcaatagaaagactctgtaacatgacagaagttattctctcttgtaacttaatcacagaagggacatcccattactttttccatattctattggttaaaggcaagtagctgagcccatacccaaggggagagaattgcacaatgaatttcaggagaaaggggtgattgggcatcattgtagagtctccctggcacaagtttatttacaggtgtgtcctcagggagcagcagggaaggagaaaaagacaactcaaagacgtgctgtttggaattggccgtggctacaggcacccagtgctcaatcctgtaaaactaggggaacttttttttgcccagggaacaaaaggggaaagaatttaaccatcaatcagctactgacccctgaggtcaagggtggctccactgctattaacttccccatgcttccaggctgcatgtgcagggttctagagcaggctcctaggacagcccacaccatgctgtcagaaaggaacaggatacaaggggagtccgggatgggacaggtgctgagaaaggcaatcggagctcgcatagaactggttgctgcctcagtagctgaagaaagaggtccccagagaactgaagccatgtatgagacatgtctgatacaaacccgtccccaggtgtgtgtgtttacacaggcctccacctgggagacagaaggcactgcctccctgtgagcttggggaaagctaacacaatggggccacatccaaatttaacattttcttccaccgaaatgtagctctttggctgacctttttctgttgatggcaccatcatcttcctctcccagcttcacctcaaagtcgatcacctccgtggattctttgttctcctttgcaatccatgccttatggggtaggactgaccagtcatgtaacttgaggactcagtgcaaagtgaaaataaggggcctcttccaagcatgtggaccagtgcgactgcacaggttgcacttccctgaagccagccctgcctgcaggatctataacttcaggagattctccagtcacatccttaggctcttagcattctctgctgtgcctttcctcttggcacccccaccaacttatgactaaagagttttctacgcttctgtggccctgaaagaatgaacttcatccaggaccctgaaggtgaccctgttagtcctgctgcaaactccatttgccataatgatctgcccgaaacgccaccctaactcctccctgcacaggagaagagtgagtgagtgagtctgtggagatggggtatgtagtgtgcaacctgcatagctgtgcttagcaacctggagtcaaagggggacttgccaagaactaaaaatggggataagggggtcttgccaccttatgtgcccagtactagtcataagaactgactctcatatatcacttactatgttccaagtgatgtttaagctctttgtacatattaattcactgatttcattctcacagtcatcttatgagacagttactctttttattcccattttaccgaagaagcactgaggcagagaaatgtaaaaacaaaacaacaacaacaaaacactttcccaaggccatgagaccagtaccagagctgagaattgagcccaggcagtccagctctcaagtccatttccctaaccactaaccacactgaaagtgagagccttagctattggagagatcaggcgtgtgtagagaaccttcagaagcctgactacctgatgatgttatgcactgtttgtggcttggagagaaaggtgtgcatctcatttgattttttcctttactttttgttgaaattactttgggaaagtctagcctatatcaagaaagagacaaatgggcaaagggagggagatggatggatggatggatggatggatggatggatggatggatgcagagatatagagagatatagattgtgcaaaatccaggttataaagaaagggaagggggctgggaaagggtggacccctaagccaggcttaacagcagctgtagagaacaaaataaaagtaaaattaaccaacctcccaaatcagtcaaaatcctacctgatttctaaggctcaacagaattatgttcccaggaagcccctgtgaatccgatgtgagatctgtctaagaagaagtgggaggctgtggtgattgcactgtttgtctctttctagaagaaaggactgtacaccagggcctgataccctcctgagaggttgtcctgaccaacagggcagctgcattgctggggaggcagcaagctggtaaggtctcacttcccagagcagcagctggtgggttgccatgggttcaggagtccttgctgacatagagtggttgccttggggacgttgaaagaggcagccttcctggccagccctggtgagcaaaggaaaaacatcggggtggggatagtaagaggaggatcacaggccttgtggagcagcccacaaaatccctcacactagtactttattgcctataagagatgtgctgtctacacaaactcccactagctaagtagcagggagaaagcagtgggggtgaggaggaaagtacttgattgcaaccccatgcattaatctccatccaattcagtcacttgggtttgagtctcttggagcctgagtggatgaatggactgagggcagaccttgagatgtgtgccacatgggattgggtgtcagtggggaggagcatagctggctgtgttctccagccaggagggacagctgccccatacctcctgtgacttccacagtcctgtgtcttgcctgacaaagtccctaggtggtttgcctggccatcatttgtcatttgcccttgcagcaagtcacaacgtggtttctctgactgctcaagactcaaagccctcttccaccacactcaaggggtgctgaaggttaggagagcaggaccccaggctttttgcaggatgacctcaacattgcccaacctgttaaaaaaaaaaagacgactaaccacaatgactgtcctccccagtagccagcttctcagcaatccgtcagctactctaacaagtataaactgaggtcagcttggggatggaaatgttcaggcctccttcagcccaagcaggctgagcatgtgagatgtgaccacactccacctgtagctgggcaaaagctttcccctgcccctcaggtcccataacctcctagcaggctggtctcaaggccacctccagacctcccacctcccaaggctcagggaagaaagcacagcacctccctctctatccttctccctcccttcctcccccacaatcacatgagcttagatgtggatctttccccagttgagtcttcagatgagaccccagccccagataataccttgactgtagaccagcagaggtggcctcttcctccccacaactgctccctctatgtaaccaagaggcaaggcctaagcagggcaggagagggtaggggaactggagcaacacatcaaagccagtcttgatctgttaaataggagctaaagaaacttggaaaaattttttcctctcctattattttgccaagaaatctcattttgaatatcaaaagctgaacgttagctcccttcttctttctgctctcctctgtagcaacctcagtctttttcctcaaggccgctggatgctgatttaggctaagaaacaaagggaaaagtctcattaatacttttcaaacgattgctctctttctcaggtcaaagccagggagagtgaaaactaggaacagttagagataaaatttgctggactatgtattagatctagaaggctggtctagcactttactgctgcctcaaagcagttacattcctgatttgacaaccagcacacagcctgctcttcctttgagcagggcagaccccattttatgagtgcaccaaggtttctccaggtggagggaacagactcaagctaaccaagtggttgcatggctgatgaataatctagggactagctaagagttgcagcacagaagatgctgaacaaagagccagatgatcacatctgcccagggcaaagcaacacctccccgggaaacaagccgacacacccagatttgcacttctcttcttttcctggcacctcactgaccgtcccctccttcatcctgacgagggcagacgcagccatctccatgccaacatactctcaccacactgaaacgtctacatgtgcagttttttcccatgtcaattgcactctgggttggatgtgtccagtgacagctgcagaggtgctgagtgcacgggtaggtgacaggcagctcggcccaggaaggtctcctctcctctctgttcccatccatgttagccttagaaagcacatcctgtctgttgtccttctccctatgtttcgacacctatgctacctctgctgactgagttaccaataaccaggattaaacatcaccatccctgcaacaatgccagctccttttccttaagcagcttctctgtgcccaggtggaggctggatgctttccatatagttcttagaaatactcaggcgtactcttaggtgtataatgttactcccatttcatagatgtgaaaactgagaccaggatagaaaaatagctggatcaaggtcacaccactaggagacgggaccgtggtacctactttttggtctgcttaggaaactttcctatcagaagtattaaaagataattttcctaaaacaggtgagatcatgactctcatactttaacgtgttaaagattttatttgacttaatgagggaaccaggcagacgttaacaaaggagaaatctgaaaagcagaaatttatagggagtaaggaaagtggaaatgaatttacaaatagactgaaactggctttttccttagggaagagggtagtcaattgaaccgctggacaggatttatttgcatgtctatagacaagaattattttgcattgctatcagttatgtacaacctacagagccataaaatagctcaaagaccctgaaaggctaaaatcagataacatgcaaaggtatgctcaaaacaacctagttttccatcggcgacacctagtgatcttttttgcttattccaaatttccttacaggggcaagtccttggccagatctaggtgatcctggtaacttacagagaaaatcatctcagctgatgtggtctggctaaggctgccagtcacatagaggaaaaagaaaaggcagatccccagtgttactcagcatctactacatgtcaggcactgcttcaaatgcttggcatatactaattcattcaatcctcacaataacctatgagaaaggcttcgttgttgctccatcttatggatgaggacaagagtatctggccagctaaggaacttgtccaaagtcacactcaaagccagatgcaaacacggaagtcagatgccagagctgttgcttaaagctctgtgccatcctgtcttacggaacaacctggaaagaaaagcagagagaaataatgatgggcaatgacagagcaagattgcagatggggctgggggtgggttctagcccctatggctctggaacctttaggaggttctagaaggttctagagcctttcttcccttggattcctcaagcaacctcagcatccttttccgggtaccaaagacagtatctctgtatccttctggtgcttaagctcctttgagttgtacttttattttttcataaagaatcttgacttacacatctattaagtgacagaactgagtttcaaaccctcatgtgcctaaactgcatagctgcgtctctcagttttctcacctggaaatgggactattctagtacccaccctgctggattattgtgacagttgggtacactgattcagtaaagctctgaaacgaatgcctggcagctaaaggtactcaagttattaagtcagtgttatcatcagctccattttgcagatcagtacactgggacaaaagatgttatggactttgtccaagatcactcacctggcactatttatgagcaaatggcagagccagaaattgaaaccaagcagtcagcagagcctgtcggcttcacgtcgaccctgggagggccctgaagaagtcatctgcccccaccatgcccccgttctgtccagagctgagtgggtgttccgggagcctgggtcaggcttccagggcagaaggactcccagagctggagctggctcctttctcagcttgcttgtgaaagaaccacaggcaggtggggcctcccagctctgagctgcagcggccaggtgagcacagtgctctggggcagtggctcccactgagccagggtcttatgcaaatgcacctgctcccacccacctacccaggtgcctgtggaggcgccaccatatctctctacttgcgctgtctccaagtcgtcttccctgccgtctccaccatatggaggcataaatccagttaatgtgtccaaaaaagaaaaatcaaaatgtcagatctgcagagatggttcaattgaaggaatattgattgtcacagagaatagtctcactttattcacctacttagtctgctcccctaggcgcatatgaattcatcaaatatcgtcacagcgcataataacgttcattcccgcattgttgtgactgcttgggctttggtcctgctcaccgtgcctgactcaggtggggtaaggccaggggagggtgggaagggagaggaggggtttgctgacatggtttggatgtttgtcctctccaaatctcatggtgaaatgtgatccacaatgttggaggtggagcctaatggaaggtgtttgggtcctgggggcagatgcctcctgaacggcttggtgccctctctgtggtaatgagtgagttcttcttctactagttcacaggagagctggttgtttaaggaactcctcccctctctctcgttcccctctcaccatgagacatgccttctccaactttgccttccaccatgagtaaaagcttcctgaggcctcatcagaagccaagaagatgctggtgccatgcttccacagcctgcagaatgatgagccaaataaacctctttataaattacccagccccaagtattcctttatagcaacatgaaatagatgaatacagtggccaaggcatcacatcatggcattttactcaggacaagacactttgccatctagcatgtgaactgatcttccacaccaccacgtgggggagtcaggaaggagagagttattcccagttttctaggttggatccgcagagttaagcaactcatccaagatcatgctgctaataagctagaatttgaaccttggtttccaacttccaatttgggacccctttcatgccacctgccctttcctgtaaatggtgcgtctgatccagacaggactagagatgggtggagtcctctgggcttctgcatggctgtctgcgctgtggatcatgcgtccactctttgtccaggcctggacgcagactcaaggagatgccccatagctctcaatgcacgtattaaagtggaaaagcaggagacatggcttttagagactaacagctggaactgtcagaatgccacactgtagacttgacccatgacccctccgaaactgtttattgagttgacatgacaccagcacaaggtaaaggctgaagaaccctgagaaagtagcacaaaacatcacagggagcatcttagccccctgagacctgcatttccttttttgttttgttttgtttttttttttgagacagaatcttactctgtcgcccaggctagagtgcagtggtgcaatctcggctcactgcaacctctacctcccaggttcaagcgagcctcctgcctcagcctcttgagtagctgggactataggcatgcaccaccacatttggctaattttatacatatatacatatatatatatatatatatatatatatacatatatatatatatatatttttttttagtagggacgaggtttcaccatgttggtcaggctggtctcaaactcctgacctcaggtgatccacgcgcctcggcctcccaaagtgctgggattacaggcctgcgccacagtacccagcccaagacccgcatttctgaaacaccaaccaagaagaggggtcaggcagccaaagcccccaaatgcacttgtaccataagttgtggggtctctccaggcaccgtccaggaaagcacaaccctagagtatttagaccagcctttttcacagtgtgtcccaaggaacaaggggtctgaagttctgaaacaattttgcagtcaaataaatttggggaactttgggttaattaaaattaaacagattattttgatccagggtttcttggaacctccatcatcttgattttaataagaacagcccatgttgcctgtggcccaatgtgcccagcactgttccaatactaactcatttccatactgctatccccattttacagttcaggaagccaagacacagagaggaggtgacctgcccaaggccaggagttctggtgtgatgagacaagatgagcaagctagaatcagcagcgactcagaggcaggtagacaacacaacacttcccaaacttactcaactctggatctgccccatcctttgttctgtcccagagcacctcctgggactcaggttctgtggaatatttaagaactctggtttaagcagcttccctgaccggctagctcaggtagctatcagagctctgttcaacggcacacctagaagcaaatgcaagttgatttggtctctgagtagtgcctctttcttgttccccagggaagctcctgcgctgtggggggcctgaatccaaaggcaggagcccctggggaaaatccaaatttttggctggatggggaccagtgcttccacctctctatcctcttccctgggccaccttgaagcagggagctgaggaaggtgggatggactccacgctcttcctcctcatcatgctcctggctggataccagttctggaaccttccagccaaaggcagaaaggatttttccagtggttagactcagcccagaggaatagagacactaatcactttgagcagctgcccctctgtccccacctggggctcagccacacccaccataatttctgactcgatgtgatgctttggctggagtccgcaacagatgcatggagtgggagattttattcccaggagtctttgccaggagatcatccctgggagggagaggggaaatgtggcctcaatagaagaatatcaataggaaaccatggtgagaagacatagttggccagagctggcgatggagtaattaattctacttaagtaaaatgttactaataattaaacgtactaattaagaaaaattggatcagctgttgtcaatgtggcacagaagcaggagctccactgacacattccttgggcagcttcccgctgggagtggatgggactagacgcagcccacatggtcaccttggggcccaggagaaaccagaggagctgtgagctggagagtcctctgtgagaggaagccacaggcttggggacatgtctcgtaaggtgacaaatccagaaggctagggaagactccatgagaaggaaatccagaatctggccccagtatgtccacctgtacaaagcgcaggaagtctgtgccagatagggacagcagagagcagctctcaggcagtagaggggcaggtgagatgcttgagagagacagatcccagtggatgggagatgagacaggcagagaggacagatcacgaattaggcaaggacagacatctgcaggtcggcaagcgagtcttcagtggtcgtaactcaggtgaagttgggaggcagcaaagtgttatagcaggagctagaactggaagacagacgtactagctaagggagggttcctcagcctcggcactatggacatttggagtcagacaattctttgtgttggagggagcaggggcctgtcccaggcattataggatgtctagcagcatccctggcctctacccactagttaccagaattatcccccaattataacaatcaaaaatgtctccagacattgctaaatgtttccttggaggcaaaatcacccccagatgaaaacaactgagctgaattttttcttttttaaccagcaactgaacgtcacaaaggtttactgcttactcctctgaagagacctgctcttcaatgggttttactccatacagtcattcaagccccaggcttcctcccactcatggctcactgacccccagcctcagggccctccactggatcattcacatccagctggccaatgagctcaggggcagtgtggagagattgaggggccaggcctggaagtgactgatatcacttctgtccatgggctactggccccacttaacagcaaagggtgaacctggctcagcagtgggcaaggagggaaccccagatatgatggacagctacccccatgccatgtcagctcctggtcctggccctgactctgccatggatggctcctctcacctgggccagtccctcctccaggcctcagtttctttctcttaaaaggccccttccataaacaaaaggtggtctatccattcaatggaatattactcaaccataaaacagaatgaagcactgatatgggctacaacacggatgaacctcaaaaacaagccgcgtgaaagaagccagacacaaaaatattttatgattccatttctatgaaatatccaggataggcaaatccatagagacagaaaacaggttagtggttgtcaggggctggggggaaggagagtagggaatgactgcttaatgagtcccaggttcccttttagggtgcttaaaaaatattttagaactacatagaggtgatgaatgtactaaatgctgctgaattatacactttaaaatggttaattttatgctatgagaattttacctaaactaaaaaaaattaaaggaacttccagctgtaaccttcggtgaatgcttaagatccaggcagtacaggaaccaggctagggcacccaaaagtaggaaaatgggaatctgttttccccggagacacaccccaaataaataagaaaacaaaggcccctagtccccactctgccttttgagtcaatgcaatataagtgagctttgtaaactataaagctctctataaatgtaagcagacattattactggggcattatttaggatctcattgttattctgaatgcagccagggcagggctggacatgaagggagtgagctgcataaatgcgtgtgtattaagggcaagccagcacaggggctctaaatgccgtggcccagaacagccattactatttaggatgatgtaaattaataatgaagctgctatttcttgcttcctaggtgcccaacactacacaacacaccttccatgcatctactcagttaaacttctccgcattcttgaaaggtagtaggattagaactgttttaagatgagaaatagaaaagtgaaaggttaaataacttgctatatgagttatctattgctaagtaacaagttatcccaaaacttaaactgtggcttaaaacacagttattatctcacactttctatgggctgggaatttgggcagagctcaactgtcctctgtctcagggtctctcgtaggctgcaattgaggggctggggtctcatctgaaggttcagctggggaaaagatccacatccaagctcatgtggtcattgtgattcagttccttaagggactgagtgtcttggatcctagctggcaggtggctggaggccactctcagtttcttgtcacatgagcctctccaacatggcagcttgcttcatgaaagtggcaagccaagaaggcactagaatctaacaagacagagattgtcatctgatgcagcctgtcatcgaagagcacctcctcacctttgctgtcttctgttggctagaagcaagtcactaggtccagcccacactctaggggaggggactaacacaagggcatgagcaccacgaggtgggaatcagggcgggggaccatctcggagtcttcccaccgtgcttgccaaaggtctgtgggtgctagaaagccaagctacatgcaccctggctttgtagaggaggctcaagcccatatcattgcactatactttctccatgttcttcaagggtaggcagggcgtgggggaaggcaaagagggagagagaaagagagagacttttctatagaacaaaaagatgcattaagctcttcctggccaggctacactgatgaggctgttcctgcaggacacagcccagagctaaggctgcccccaatattaatggtgtcctcattaaagtcatgagcagggctatattttaattgcctggcagagccctgagcacctaaaggggagacttgccacatcctcctcatcatgactattaataggctgggaacattcagggctgctcaagcccagggttggcaacccccactccctccaacacaagcagctcaagtcttctccagaccttctttacaccagccccacagacctgcagtaaccaagggcaacacctggccttttccccaaggctggtatagtgtgtgcctggaacttggtcttctgagcatctgggagacaagggtgaaagacccaacccgtcaccacccaacctgctcaagggaagagcctcatctcctagccctgtctccctggcagccagcacagtgcctggcaggtgggcctcagtgcatgagatgagtcagtggctgcccacaggggtcatctatgcagatgtggtaggatgcccatgagaccaagtttgagcagggaaaattagtctccaccagcttctgatttcccatctatctttgggtgagggggatgttttcaaactctctaatggccagaagaccaaggcagaggggagaacacctgagattagcaggctgagtgcttttgtaaatatttaccttcttggtgccccagggatgtaaccatacaaaatgtaaccctcccagcacccccggcttccaattcagacagggtagagatgccatgcctcagtgtacctccagggttggaagtgaacacctgccattgtcccacccgcatttctttctctagagattgccaggttttgaaacataaaagcttctatgcaatccccttccagccatagagtggcgccatttgctcttcagcctcccttccaagtaaaactcttgagagattccagtgtgcattgctttctccattctaggggtacctatcatcagtgggtccaaagtgagttctctggctgctttcttactaaagcagggattaaaaaaaaaaaacatcttaatatcaggatccattccacctctgactatatacatgcatgtacatacagcctgacagtctgtgccacatgagtagtctagaaggccacctttccttccacggcctccctagcttggacgggctggtaactgtatcattcttatttgcaaggctggactaaatcttgtagggcatgttatccaatggccacagagacctcttgactcctccaacaggaaaatgggcagctcctccccctgagaagtcttggccaagcagggtcagagcccccacaccctgcccacccactccctacccactcctccccagtcacaggtctcctttcctccaagttccagcatgcctcctcctgcctccctaggcccaactttgctgtgctgggagcaaagaaagctttattgaattttcgcgagtactttgcatggcatctgatttacaattcataacctggattatactgcgagttcagccttccggggtcggtgtaatttagatcttggaaatatttgccgtgctttcaattcccctgacatctaagggattggaaatggattctgcccctggaggtttgctatttggaggggccgatggaagggggtacagggatgaagacagctcacaaagggaaggtggggagcagtgaggcgtgaaaactgaggtagggaaaagataaagttaaacaccagcaggagggaatgatcacatgcatgagacagaggggcaggggaggccacgtgaccaggctccctaccacctgcacgcgtcacctctgcttgtgtggtgatggccctggggacaggagtgctgctgtccaggggaagtgccttggcagcgtggagcaacccaccttcccatcccaccttctggtcctgcctctttccctacctggctgtaagaggggcaaatcccctagactttttctttaaccagtcttatataattcacataccatacaatttgccacttaaagcgtgcaattcagtccaggcatggtggctcacacctgtaatcccagcactttgggaggccgaggtgggcagatcacttgaggtcaggagttcgagaccagttggccaacatggcgaaaccccatctctactaaaaatgtacaaaaattacccgggcatggaggtgggcacctgtaatcccagctattcaggaggctgaggcaggagaaccgcttgaacccaggaggcgaaggttgcagtgagcagagattgcaccactgcactccagcctgggcgacagagtgagactccatttcaaaaataaataaataaaaataaaatttgcgattcaatggcttttagtgtatttacaaagttgtacacacatcaccatgatcaattttcgaacattttcattaccccaaataaataccctgcaccccttggccatcacccctgtactagtttcctggggcaattgtaacagattaattataaactcagtgcctttaaataacagaacttggtcctctgtctgttgtggaggccagagtctgaaatcaaggtgtggtccgggccgcggtccctccaaagactccaggagagagtccttccttgcctcttccagctcctgggggctccaggcactccttggcttggggctgcatcgctccaacctgtgcctctgtcttcactcggccttctcccctgtgcctctgaggaccaaatctctctcagccttttccttataaggacacatgtcaatgggcccaccctaaacctagcatgacctcatctttagggtctaccataaatctagcatgacctcatctttagggtccaccctaagtctaggatgacctcatctgcagtgtccaccccaaatctaggatgaattcatctttagggtcccccctaaatctaagatgacctcatcttgatacctttaacttaattatatctgctatgaatcttacaaaaatgagtccacattcacaggttcttcaggttagaatatggacgtatcttttgggggaacacacgtccacccactatattgtccttttgcctctgtcttccccagcccctggcaaccactgatctatatagatttgtctattctggacatcttatatgaatggaaccatacaatatgctgtcctttgtgattggtttttttcacttagcacaatgttctcaaggttcatccatgttctagtacgtatcagtatttcgtctctttcaattattgaataatatggatatataacatcatatctatccattcatcagttgatagacatatgggtgttttttttttttttttggctattctgaataacgttgctgtgaaaattcatgaacaacccctaaccactttttttttttttttttttgagacggagtctcgctgtctcccaggctggaatgcagtggcgtgatctcggctcactgcaagctccgcctcctgggttcacgccattctcctgcctcagcctcccgactagctgggactacaggtgcctgccaccacgcccggctaattttttgtatttttattagagacggcagggtttcaccgtgttagccaggatggtctcaatctcctgacctcgtgatccgcccgcctcggcctcccaaagtgctgagattataggcgtgaacccctaaccacttttaccattagcgaaatagtgagaatttcatatttgtcttccccaaaacccagcgttaggatgagtacggcaggcagcttctagaatggctctgagtgttctcccatctcctggtattcacgctcttgtgtaatcctcttgccttgagcatgggatggacctagtgacttatttctaagaaacagaatatagcaaaagtgatgggatgtcactaccaagattaggctgtaaaacactgtaacttctggcttgctctcagtctcttgcttgatcacttactttctctgttgaatcaacctgctatgttgtaatcttttctatggagaagcccatgtagcaaagaactaaggacagcctctggccaagagccctctagggactagggcttgccagcaaccacatgagtgagcatgaaagtgaatccttccccaaccaagacttcagattagactgaatccctagctgacagcttgattacagcctggagagacaccctgagccacagcactcagcaaagatcaccaggattcttgacccttagactgtgagaggatattgtatgtgtgttggtttaagctactccattttaggctaatttttatgcagtcttaaataaagtgaagacagaagaaaagatactcttgggagaccctgagctgccaggatggtggatcagggatgagcttattgggaatgacacttagcccagatgacctgatgttgaaaagtcttggctgcagacatcccaacaccaaagtctattaaatgatttcattttcttctttgggatggaggagaagtgctgagataaccagagtgaaaaaatcagatgtgatatgccatcttcctccctctgaagctacagagccctgaaggcatggaaggcacggaagttgaaggaaggagcagtggttagctccaaatttgctcaaaagcactacaaagagtagagttgggtcaaggaactagaaatctgggcttccaggacagtgctctttctagtgcactagatttcctaaagggcaaagaaagcacattatctgatccagaaaagactgcttagggtggccgagagggtgaatacctgaggacaagaaaatatcaaggcttaatggcactatcaaagtgttaaaattttattacaaaaatggctctgaccatatcactcatcctacatggtcttctcacaatgtgactttgccacttcccctatcaaaaaggaaagtcaacatcttccctgaaacctaatcagaccttagtgactccttcagcaaagtatagcaggaatgatgctacatgacttccaaagctaggtcataacaggtgacacagtttccacttgcctctcttttgggatgcttactcttggaacccagctgccatgttgtgaggaaccccaggccacacggagaagccatgtgtaagtgtcctgtcagacagctccagccaaggtcccagccaatagccaacattaactaccagacatgagagtgaggaagtctttcagatgactctagccaccatcggaataaaaccacatgagagaacccaagtgataactgactggctaaaaccagttaacctcaaaaatcatgaggaatagtaataattaatgatagttgtattagtctgttcttgccctgccacaaagaaccacttgagactgggtaatttataaagaaaagaggtttacttggctcatggttctgcaggctgtgcaggaagcatgactggggaggcctcagaaaacttacagtcatggtggaagatgaagaggaagaaggcacgtcttacatggctggagcaggaggaagagagagaagagggaggtgctacacatgtttaaacaaccagatctcctgagaactcactcactatcacaagaacagcaagggctaagtctgcccccatgatccagtcacctcccaccaggcctctcctcaaacattggggattgcaattcaacatgagatttgggtggggacaaaaatccaaagcatatcaacagttgtttcataccactacatttgagtttgtttgttacatacctacaggcaacccaaaccaagcaataatgctataatcatgaagatgatctatagatagataagctgatagatggattgatggatcaatgggtggatggatggatagatggatgaatggatggacagatggatgaggaggtggaatagggtaacagagagacatcaaatcagtacttactatgtgttcatagtagtcattgacactagaccaagggatttattgacattatctcttttttaattctcacaacaatcttatgaagctggtattcttattcccatttatagaaacagtaacttagatttagagagtttcaataatgttcctgaggctacacagctagcatggagtaggttctcctgacctcaacgtccatgatcatgatacgtctggtgtggagcacaggtaagagtgtgaaactgagagtgaacgtaatagaaattctaggcctaattaactcaggcagaccttaactattcatgacaccagcctgacctcttttctggatgcctcacttcaagattttatctggagtacatgttgctctttattctcctgctgaggactacagaaaagcctattttttgacataagaacaaggaacctaagagagaagcctccctcctgtgctgtcttttgttctggaaaggcaatgaccaaaatgggaagagctgttttgctggtattgttgttgtcatgatggtgatggtgatggtgatggtggagatggccatgatgatggtgaatggtagtgagtggtggtggaaatcgtagtagtgatagtaatgatggcgataatggtgatggtggtgatcatagtgatggtggtggtggtgatggtagtggtgatggctatggtggtgatggtggtgtagcagtggtggtggtggtggtaatagtggtggcggtggtggatatggtagtgatgatggtgttaatgattttggtcatgatggtggtgatgataatggtggtagtggtgatggtgatagtagtgatggtggtggtgatggtagtgatgttggtggcggtaataatgatggtgatggtaatgattttggtcatgttgatggtgatggtaatggtggtggtggtgatggtgatactagtaatagtggtagtgctggtggtgatagtagtgatggaggtagtggtggtgatgatagtgctggtggtggtgatgatggtagctgtggtaataatggtggtggcaatgatggtgatagtagtaatggtggtgatggtggtagtggtgttagtggtgatgatggaggcaacagtggtggtgattgtagatgtggtcatggtgatggtggtagtggtgttagcagtgatggtgatagtggtgatgatggtggtggtaatgatggtggtggtggtggaaatgatggtggtgttggtggtaggcatggtagtgttgatagtggtgtcagtgacgatggcgttggtgttagtcaaaagccatggaccctctctgcagaaaagggaggcctctggccaggatcatgccaaaccctctcctctaaagtccaacaaaaggagatgggcatggtacttggcatccatagaatagagctgattatataaggcccttccaaactcttccagcagccaagagcctcagagctattgacacttgccttctctcctatgtttgttctaaatctggctcactgtggctcaagagctattactgattctaagttaaaaacccaatgcaaatggagggtccttgtaagtttaacacatcactcccaaggctcagcacagtgcctggcctataacaggcccttgatacacatttatgaacaaacaaacccttcagcaagctatagtttaactgaggaccagaaatatccacagttggattcaaaagtatttcctgaagctctcagggaggagtatcctaatctaggagttgggaagcctggacctcccttaagagaaagatggcttcagagtccttctaaccatagacattgtgccttaatcacattattcaaggatgcataaactggctgctgactaagccttttgtgtggcctggaagaaaacagattttttgagaacttactacagtaaaaagtaatagttaatgtttctgatggcttgtgatgtgccatttaaaaaccacacaaatttacttatttgaactcacagcaaccctatcatgcatgggttatcatcatcaatcatcatcatcatcattttatggaggaaaaactgtagacaagacacacgaagaacaagcaagctgcccacagtgtcacagctagccaagccagagctggacaaatcccaggcagtctaagctgctaaccactgttcaacctggcctcttgccttccgatgtttgctatgagcctggccctgcactctgcatctttctatgagttgttgcattccatgatggcttcagttctatgcaataggtgtgctaccgaggtcttgggagggagcagttggcctacttagaggtgtgatgggagagagtctgatatggtttggctgtgtcctcagccaaatctcatcttaaattgtagctcccataattcccacgtgttgtgagagggacccagtgggagataattgattcatgggggcagtttcccccctaccgttctcatggtagtgaattagtgaatgagtctcacgagatctgatggttttataaggggcttctgctttcacatggcatgtctttatcagcagcatgaaaatggactaattggactctgtattaacagagtcctgatgaaagaaccattgacaatggtgtaacaggctaaggagatccaaggaatgtgggtgtcgcacccagcgcccagccagagagggaagccagtatgcccctaggactgagtgggtaaaggaagagcttggagacagaggggactataggggaaggccttgacagctactgccaagccactgcctggcctggaaggagccaggacccaatgtcgtcacttctctcatcttaccctctgagctctgtcactgccacatctgtgcaagccagagctaaggtcctcagagaccagcctcccaatcagagcaggtggagaagaagggagggtggtcggcaaagtaaacggacaccttccagcacagccgaggctaagaagttgagactaagaaactttacgcaacttgcccaaggacacaagcttggaggtgagaaagccaggtggacttcagaattcttcccaaggctgcctctgtggcctgagtcacagtgaagaaggctttcgtgtgtgtacattggtgtaaatgatcatcagccaggctgccagcagcctccgcagtgttctcataatgggattttaattcgcttcccccatcgtcctgctgagctgagaagcgctcctgtttgtctacttcttgttaggctgctgcttcaaagcagaaacaggaggcagtccctctggtccacttgcctttcatgctctttgggccaaacccctttcctcacgtcccccagcagtttccacaaatgctgccatcccgcctgtagccagagaggagaagatacacagagtgcatctttggaaagaggagaggacctgaccacagtcccgggacactgaccagcagcctggcaagaacagaaagtggctgtctaccctgagccaggctttggagtctaacagaaccgggttcccagtcttccccatattgggaagcaccaccacagtcacccaactgttcaggaccgaagctcgtgtgttcactcttgactcctgtttttctcacccctacatccaaccatcaccaagtcctttccagagaagcaatcccaccagtctgtgtccattcttctgacaggctggggttgacttccgtttctttggacactctaagtggaattccttttataatggatgtgttcctgcaaatttgggcttaaactgcatttttgtaaattgaaccccagcatgccattggcttacccaagctctcactgaggttggctccccagggaatcctaatactttaaccctatctctaccgctggaagactctagaattttccaaaaggcattttgtactgacccactcatgttcctggtcacgggttgttccatgggttttaactactgtgccacttattgagctcctaggagcagttcccggggctgccctgtaggcagcttccattggtactgatggaaatgactgtgctggctgcactccactggactcccccatcgtcccctcccattgccctgccaaaccatgctctcttctcccctctgctctgtgccttggaagggtgacttctccaggctgtgtcagctgggcccttttgtctcctgccttctaattgggtttggcctatcagaggcactggcaggagacagagggcaggaggagggagcgatgggggtactgattccaccctctccctccctccctgctgctgttctgagagcagctgtttctaccagggccatggttcctgttgggtggctccctctccatggctccaggctccgatacctccacttattttccttgtccctttggacctaaaggtggcaaagcctccccactcttgctggcccctggatcctacaccaggggagctggtttccttaactcttctcacaaatctataaatggcctctttagtaaactgcctttgctggaacccctcaaggataccatctgcttcccgccgggaccctgcctggcacaacgacagtcatgacgatgatgttgccatgctctgaagctcaaaagcctgactcccaacccccacccagggccctgggtaactcacttttagccccagggtaagttgggaggaagactagatgcctccgaggagtccaaaaatgccaaggtggggcaggcaccccgagggcagggcttctcagcctcagcacgactggtattccgggccagatcattctttgctgttggggtggccggggctgtcttctacactgtaggatatttagcagcatctgtggcctctacccacttgatgccagaaacaccccttcccagtcacgatcatctccagacattgccaagcatctcctggtggggagagtaccccctggttgaaaaccctgacctccaaaatggtggggcatgagctgagggctagctgggctggtttgcttcttaggagaagcacagagcaagcatggggagaaacccaagaatggggtcctcggccaggcagagattccatcgcggctcctccctgtgcctttctagcctcagcaactgggcgggaccaaggcttggcgaaactcactggtcaccctcagctcgatgccctgcttggccctgctgcctgagcgcaggagtccaaaaggcaccacttggctctctcctggccctcccaccactcacccacactctcctcctctccccttacccgcctcaaaatgattctgggaggcagctggcagcaggggagtacagctgccgctaagttatccaaacgatttatcttaagattcatgcagaattcattgtgtggggaccagggtgggttgtgctttaatattcatgcagatttggaagaaatgttaatcacgggtttgggtaatttgcacttttgcttaattctcctcctcctaggctcagttggctgccccgctagccccctcactcctctgctcctggctcctgcgccctagagttcttccagcccaccgtgcagctggggtggactcagaggttggagggagggtgctgagctgctgttcccctggtcggactggccccacagcacctcggggtggggagcgggagacggggtgggcagcggcgggaagagctgcaggagcctctgggacatcttgacgggaaatagataacctgctgtagcaaccagatatgtgcaaattagcattgattattctcaaattaacagcttgggcatttcaaacccaaaacaaggcctcagctctgctctgatcttgccctccctcccagctcccagcccggactgttaccccctccccacaatgacaaccatctgggcctgatcagggtgagaggcaggcttcctgggggaggggacctggggggtttccagcagatctcatcgccttcttacccctcacttggacctggggcctgagtacaggggcccaaaacaactggcaccctctggctgctccctcccagccctcgcacccctcacccgtgctcccctcctctccccttaccacctcccaaatgattttgggaggcagctggaggcaggagaggaagagattcttctgaaaattttccctggttcccactgcccagtatagccaactccacctcctcagccctactttcggggtccaaacccctggaaatcaggggttttgaaccagggggagctttgcccccccggagatgtttggcaatgtctgaagatgattgtgaccgggaagtgttgctctggcatcaagcgggtagaggccatggatgctgctaagtatcctacaatgtgcaggacagccctggccaccccaacaacaaagaatgatccagcccaaaataccgaaagtgctgcggctgagaagccctgccctcggggtgcctgccccaccttggcacccttgcttttcctcagaggcacctagtcttcttcccaactcacctgggggctagaagtgttacccagggccctgggtatgaaccccacatacatggagaagggggcttaggactcaaagccacaccccatgagcatgtgtctcactctcttccaagtgaggtggagacagctggagggggcccaggagccacagcagaagaacgctggaaaagccctgagtgccccaggcagaggatccagcgctcagaaggggctgctctctacactcccctctccatttcaagataagaaaagtcgagtccagagaagcaaagccactaggccaaggttacacagctcattagtggcagagggagctctgagttcaagtttgcctgaggcccaatcagatggctgcagcatcagagtccaagcagaaaacaggcaccactctgagtgtctaaaagggggagatttatgcagggacttgattgcacaggtgaaggaagaactgagaaggggatagggaggcaatttgggaattagcaacagtgggaagctgctaccacctcaggctggaggacaaacggaggagaaggcatcagtggaccccacagccaggtccatcgtggaagctggtggatctatctaaagagagcagaagcaatgatgaaatccagcaatgctggaaaggaggaggaaaaatactctagcttctccctcctgcttgctcccatctcctgccgggacttaatgtccaaaccagtcaggagccagctgccacggtcagcccctcaaggtgctaagcagagcaggagcatcgaaaacgggtctgagaaccagcaggcaattgaccagcacaagaacttccaaaccaaatgttgttcccctccctccctcaggccttgccggggacttgtgaagaggagggtgaggaagaagacccaggaggagaggcaccacaggcctgtcccatgcaccggagtcagtggagacagcgcagctgagttgaataaaaagggagctaggggctgggggtgttgagagttggctctctctcctccaggcccatcctcccacccctgctgggatctggtcagcttccaaccccagcagccggtgttacctgccactgcctgtcagctttccccccaccacgcagctgcttctatcttggcccagaatgataatcagggagccacagacacagagaaagtgtggcagcagcccagatggccgccccttcccctaccactcccttgctatgaagactgggtgtccaaatccctagcgcccacccccactagacacacttatatgcatgcgcgggcacaacataccaaggtgtcccagaattaaagttccctgggaaggctctcagaccagaccatgtcaaaatgcaacagaatatctattaaagcagggagtcaatgagatgctcattgaaggggggcacttagaaatagtctcagccccttccttatctagtggaggagaactcacagcagcatagctgaccttttccaagagggaaccccttgaaagctacaggtgtatggcaaggaggccaccacctgttgcaggtaaagggtataaactgtgacatgccctgagagccccgggattcagaggtcacttggaatagatggtccaaaggtcgcccaggatagctggcccaaagcagcgccttaacaccatacctggcacatggtgagcatttaggaaagcacttttgtctgcttaaatttctagcccttctttgggctcttttgggagacccctcatgcactacatgagcttcaaacacagtggcctgagtgatccctcctggttacagagtgatcatgtgacatcatgcatgtgatcgtgtgactgaactgtctcggggctgcattccccagatcagagtgattggttcagagatggacatggagttcaagccagccaagtagtcttgctggggcaaatctattgactctgttggaaaaatgatactttggcaggttcacagatggtaacaaatgtacccctaggtgcctgcatagataggaggcgaggctctcagtatgaggggcagggggtatacgagaacactgtattttccactcaattgtgttgtgaacctaaaactctctaagaaataaagtctattaaaagcaaaaaggttaaggtctttaaatcgggggaaaaaaaaaacagatagatgccaatatagaaaagaaagaaatacaggttgtgtgtggtggctcacacctgtaatcccagaactttgggaggccaaagggggtgaataacttgaggtcaggagttcaagaccagcctggccaacatggttaaaccttgtctctattaaaaatacaaaaattagctgggcatggtgacacatgcccgtagtctcagctactcgggtgtctgaggcaagagaaccagttgaacccaggaggtggaggttgcagagtggagatcgcaccactgcactccagcctgggtgacagagtgagactctgcctcaaaaaaaaaaaaaaaggaagaaataatatcataatttaatgttgaaatatttctgtgtgtgaggcagaggggctgggaattgcgctttgcaaaataagagctatttctatgaaattatatattttggggggcatttagatacaggaattacttaaatagtttagcttctattgaacttttgtgtatggggtatgagatggtaggaaaggccatttgcaactatctttttaaaaatcataaatgcaaactaagctttttctatgaaattatatattttgggaggggcatttagatacaggaattaaatagcttagctgctattgaatttcttttgtgtatggggcatgagatggtatgaaaggccctttgtaactatcttttaaaaaatcatttttattgagtctgaatattgtaataatattttgcactacagttgctagtgctgggtgaatgagagcctgcagggccagtagttatcctgcctgtgctgtgcaggaccctgtcatgagaatgaatccaaattgaagttcgaagaggagagaaagtcctgatgacattgtttgaacccctggaaacactcatgcataaagtcagcacaactcttggacatttcagatacatggaccaatgaattccctaattcaagttgtgtttctgttacttgcaacaaaaaagccccaatgaaataaatcaatggataaatgagcatataacccaagacttgaaagaaaagaaacttcaactcccattcccgagattcaaaggtaaagagatttatgtggataaagcaagatagaccagcatggctacgcacaaagcttagtggctgagaaaaacaatgagaactcttgctttataaaactgccatgtgaaaggaagagtctaggctggtgacccagctcaatgcaatggcttaaaggtttgttcagaagagtagattttactagaaactaaggctgatgttggaagctccccagatcaaatcatcctatcacttggttgcacagtgggagttgttggccaagcatggaaatctgaactatagggggctgtgacctcgatgcccttgggtggcactgctgtaccctgagttgggattgagaccatgaagcacctgccattaattagtcagtgtcactcactgagctctgcaggcccagtctccaacagcgacatcaggtggcagtgggaagtaatggcagtgattgaccaatgagactgtacttgtcaagtctctgttggaatagggctgtaccccttagtgcagagtaagtccctgagattctcggacaaatccagtgtgagggaggccacaggaggagatcctggacattgtgagtattctggcaaacaactggaaaaaaataagagctgtaatatatttgcctcccaaactggaagatcaagtcatgttttccaaaagatgtttaaggctagaaggtcaagagcttaaaagtctgattccagcctctcattaatccagtgtgtgaccttaggtgtgtcatgttcacttttatttctttattaacatcccctcccccccacactggaaaaagagaatgagaagagccagaagtccccttccagtgcacccacagatgatgcggacaaagctctctgaaggcctcacctacatcaggtggcagtggctccaggcaagtatctctcctactatacaacatcccccatgccctgcggctataggaagctgccaggacagcagacctggaagaaagcatcctcctggggtgaggaacaatgcacaatgtgggatttgtatcaggggtggcccctagcattgagtttaggacaacctcctgccaagcagctctcaccaccccaatcccagtccccgagaggccaaaacacaaacctgacacccacttcagggcccccttgctcctctcctgtgacacctacctctccctatagaaaatgccaagtaggggccaggcgcagtggctcacgcctataatcccagcactttgggaggccgaggcgggtggatcacgaggttaagagatcaagaccatcctggccaacacagtgaaaccctgtctctactaaaaatacaaaaattagctgggtgtggtggtgcacacctgtagtcccagctactcgggaggctgaagcaagagaatcgcctcaggtggccattgcagtgagccgagattgtgccactgcactccagcctgggtgacagagcaagattctgtctcaaaaaaaaaaaaaaaaaaaaaaggaaaagaaaagaaaaaaaacccaagtagggcaggaacacctgtgggccccaggatgctggaccacagcatgcaggcaggaagagaaccctcactccccgagctagacggaatctcagcaatgttatttaagtgcttcagttcacagataaggaaactgaggcccagtagggggagtaagtctagaaagcctcccaaagggatcagcggctgggctggccaaggctggggcccagctcacctgtctcctaaccccacactctcttccagcatccccctcttcccaatgccatatcgtctcagacaggggctctaggtctctcagcacagcacggccagctcatggccacagacaaggatagtgtggggcagaccagtaggcctctaagcccatcccaccccacccttctgcccaaggcagggagcttctgagcccacagcaatcccctgagcttccaaaggctgcagaagctctgtccagaagagtgcagacttaagggggatttgggttgagcaggaagaaagggagtggagggggctgaggcccagagttgtgctctgaggggactggctgtggacgccgagagcaccgtatgtcaaagctagatccgagctcagacataagcccccttcccctccttagagggaaaatacacaagctgctttcaatgaaggctttaaatggaacgtgtccaggcatttcaatgttctcttcccagaatagggccctcaattccatcttctctgagctggcaactaaggaaggacatctctaactttgcctggaaattataagtctgccccttgctatttgctctgtgagagacagtgcagtgcagtggtcgggctggagacgccagcttagatttgggggtgaggctgcctctctgggtgtggctctgccacttactgactgggtgagctcaggaaaccactttatgtctgtctctgagctcccatttcttcacctataaagtagcaggatagcattgcctactgtatttgtttttcattgctgctgtaacatgttgtcgcaaatttaatggcctgaaacaacacaaatttataatcttacaattccataggttagaagtccgccatgggtctcatggggctaaaagcaaggcgtcagcaggtctgcgttccttctggaggcttcggggggaatcatttcccctgctttttccagcttctagaggctgctcacattccttggcgcatggtcccttaacctctgtctgccaagcctgcagcacagcatctctctgaccatcctgtcatcacatctccttctctgacccctcttccgctttaaagacacacccaagttatgataataataaaccccccagccccaaatccttaacttaattacatcttcaaagccccttttgccatgtagggctccaggaattaggatgtgcctatcttttgggagaagggagtataattctgcctaccacatctactttttagtgttgctgagcgggtttaaggcaaggatttagcacaatgcctggtacacagaaaccactcgataaagggcagctgtattcatggacatggcctcattttgtgatgtcttccaagggcagctccgcctgcctgtgacacactgtgccccatcccctgcacacacatcacaccaaggccagcatgcacgtagcacccagggcacatatgacaggcttgctgcccgctgtccctctgcacacagcctgcctctggcgcaggctccagatgctgctgtgcattttgcttctgctcaggcatttgcatcctcttgcagtgccacagatgtttgcacagatgttcatatgctgacagacacatgtgcacatacatgatctgccactcagatcagcaaagtgcacacagacacgcacacacttgtcccatataggcatgtccacatctccccagaccccactgacagaggcccctgctcagagagggcactgccactttttctggccctgagcagattgagctgcctccctgtcccctgcagcctgcactcagcagccccttccatgtcttgtcctgagtgtcaccacctcccactcctgctcccagagccccagctccattgattggccttgcagctcagcagccggagatgtgccccagctggagcaaaacacttgtaatttatggagtgtctgatttttaatcagttttttgttcctgtgctgtaattgtcctaattagatatacatattttgatgaaggtttttccaaaataaaaattgtaatcgaatcttgcttgacattctttacacccactcgctcagatccaaacttccacagcagcaggctctggaaactgtgcatgcagctcaggcatctccacacacctcccctggaccactgcaggagctgtcctgtggctctcacaggctggaaggcaggcgcccactaggcagggcagtttcctttgccctgggcctccaagtgccccatcagggtggggcagccttctccctgcgggtctgggccctccagggcttctgggccaaggcttacccctgggggagggctcaggactatctagcactgaggtgctctctctctgcccatgcttctgctccctgggaccccttcaccaaccacggagaattgatgccatcccacaggcctcaagggcaaaggctgcttctgtcatcccccactctgataaataacaacaattcctgccacttacggagtatctaccatgtgccaggcactgtattttatatacattagccctaatctgcataacaaccctcggaggggatttttcagaggaagaaatcaagacttggagagggtaattcactcgctcaaggtcacatggcaataaatgaaaggactgcagtcctctttgccagaacactgagaggtaatggctgccttcctgggaaaatccaagaggagctgcagtcctccagctgctcctcttagggggaggatccacagggctgatcttacccctgcaccccagcatcaatctgcagctgaccttgaatagccaatgatgcaaaattcctccttctgagcctacagtacagaccacacatgagaagtctggtgtctgtctacatgagtctctctaggacctggaaaccagggttcaggtatcagtgtgtgaccaagaagtcagccctgcgactggctgggaggctgtggacaagagctgtttcctaggatctcagactccaagaaggaccctcgcggcaaacctatcaggagatccaagctaagaactttctgtgctggttcttaaactgctgactcttacctccaaacctcccagtcatactctgcaaaccatggttgtgcttcgcctgatgcacccagttagctcctgccagtagggggcactcgggagacaggcaagaagagggaggaggacttgttcctttcctttgcttcctgtccctctctggtgatgggtcttcaatctggtggtggagctggttctattgtcagtagttggtcctagtttgcaatgtgcttgtcccacacttcagaaggtgccttattgtgccctctcagagatcccagcagcaactggcacctgccccatccctgaagagctctgagttccagctcctagtggcctctccaccaagcttttaaattccaataatcccaatctcttcccttgttccctcagccctagggatggtggctgcttcttgcagttgctacctttatgattgcttcataagtatcacagaacttttgcagttctccaatactccaactccttctattaaattctctctgttaaaataactggtgtggtttctgatgttttactgccctacaccctgcatggtgtccaactgtaaactggaaaaggtgtgttgagaggtgccacagccacacctgtgttggggagtgtggcccactggcccacagagctgggcaaaaaaaccagcagagaactatgccacctctagtgctcaatcggcacactaggctgaactgataaaggagtaagtgaatgaatggacaaaagaattaataaatacaataaaaatgatcaaccatggagcagtctgttccagacccagacatggcaccccccttcttacagagcccagcacaggctaaaatcaccaagacaatctgatttggtaatggttaagatgagaagtttgattgttctctggggtaatttgacacagaaagggggagtaggagcaacactgagcaccagctgagcctactgactgtagtaattagggtaattaaagctagcaactggcccaaaaatcttggtggtttaataaaactgctcagtggtttatttctcactcacctcaagttgaatgtagatgttgctgatcaatcagttcttccaggagattcccctccaagtggtgactcaggtatccaggatcctccctggatcttgaggctctgctgtccctaggatatcctggaagtcctctgttagggattccctatattgagctgaaagatgagaaaagaaagaaaacatggagaatctcccacccaatgctcaaccaccttggcctggaagtaatatgcatcatttccattcaaattccactggtgagaactaatcatatggacctacctagatgcaagaggggctggaaaatataatccatgactgagcagctattttccagaaatggtgatacaccatggatgtggaacatatttttgttggtcagctaactatttctcttaccctcaggtacggtattaacttgaagctatgatatcaaaaatatgttagatcttgtcttagtctgttttgtgtggctataacagaatactacagactgggtaatttataaacaatagaaatttatttggcttatggttctggaggttgggaagtccaagagcatagtgctatcatctgatgagggctttcttgccatgtcatcccatggcaaaaggggaagggcaagaaagtacgtgccaataagagcaagagagaaaggaacctaacctatccattttatcaggaacccgctcccacaataataccattaacctattcacaagagcagtgccctcatgacctagtcatctcataaaggtcctacctctcaacacaattgtattggggattgtgcttccaatacatgaattttgggggatgtgttcaaattataacattccactcctggtccccaaatttatatcttcaccctgcaaaatacattcatcccattctaatagtctccaaagtcttaattcattctagcatcagctcaaacgaccaaaatccaaagtctcacctaaagtagatgtgggtgagatggaaggcatgattcatcctaaagcaaatttcctccggctatgagctgtgaaatcaatgtaagttatctacttccaaaatacaatggtgggacaggtatagaagagacactcccattccaaaaggaagaaataggcaagatgaaaagagtaataagccccaagtaagtccaaaacccaatggggaaaacaacattaagtcttaagtcttccaaataacttttcttgactccatgccctgccttctggaaacactaggataaagactgggccccacaaccatggttttactgggctcagttcacccagcagatctcatggactggagtctcagaccagcagccttttttttttttttttttttgagatggagtctcgctctgttgcccaggctcaagtgcagtggtgcaatctcggctcactgcaacctctgcctccagggttcaagtgattcttctgcctcagcctcctgagcagctgggaccacaggtgcacatcacccagctaatttttgtatttttagtagagaggggtttcaccatattggtcaggctggtcttgaactcctgacctcgtgatctgcccacctcggcctcccaaagtgctgcgaccacaagcatgagccaccatgcctggccgccagcagctctcttagtctgttgctgcaagctcaagctagttactctatagtactggggtcttgggaatggccccactcggcattgccctagtggggactccgtcatagctctgacttcacatttccacttggcattgccctagtaggggctgctttctatggtggctctgcccctggtgacaagtctgtggctgcagccctcgactgtccacatcatcctttaaaatctaggtagagaaagtcatgcccccatagctcttatattctgtacatgtgcaaaatcagcaccatgtgaatgctgccaagattcacagcttgtaacttctgtagtgggtcaggccacatctgggcctacttgagccatggttggggtggctgaggagctctgcacctgaatgtggggaacagaagcccaacgtggctctgggcagcaagcccatgaagggtaccccaggatcatccctcaaaatcattctgccctgctagagctctcagcctgtaatgggaggagtagcctcaaagagctctgaaatgcatttggagtctgttttagtctgttttctgccaatgtaacagaacaccacagactatgtaaattataaacaaaagaagtttatttggttctggaggctgggaagtccaaaagcatgatgctggcatcagggaatgaccaccctgtggtagacaggtggaatgcagaagtttgcacaaaagacagaaagaaatgggcacaacttatccctttatcaggagcccgctctggcaataactaaaccactcctgcaataatagcattaatctattcatgaggaaaaagacctcttaattacctaattacctcttaaagttcctgccacccgatactgtcacattgatgattaaatttcaatgtgacttttggaggagacattcaaaccacagtaggttcactctcccattgtcttgttgattcctatcagtactgaccttcttagcgaatggtcacttaaccacatccttagtttgctctcctaaacatgttttttcattcttcacatggtcaggctgaaaatttttaagatcttttcattcttcttctcttttctgctaattataaattccatcttcaaatcatttatttccttaatgtatatgattaaaagtagacagcttcttcactattttgcttaaaaatttcttctgccacatatcctggttcaccactcttaatttttgccttccataaggccctcaggcatggacataattcagccaagttctatgcaactttataacaaggatagcttttactccagttcccaataccttcttccccatttccatctcagacttcatcagaatggcctctaccatccatatgtctaccaacattcagatcacaaccacttaagtaatctctaagaagtttcagactttacctacatttcttctctttttctgagccctctgcagaatcactctttactactccattcgtggcaatctagactttttctaaccggcttctctagatgcttccagcctctactcattacccagttccaaatctgcttccatagtttcaagtatttgttataaaaaatagtcccacttctcagtaccaatttcctgtcttagtccattttgtgttgctacaacagaaaacaacagcctgggaaatttataaacaatagaagtttatttgactcatgattctggaggccaaaaagtttaagagcatgatgccggcatcttgtgaggaccttcttgctgttatcattccatggtagttggtggtagagcaagagagcgcacatgagcaaaaccaagagagaaacagagacaaacgtacccttttttaatcagcatcccactcttgtgataatgccattaattcattcatgagagcagagccttcatgacctaattacctcttaaacgtcctgtttctcaacagtttcacattggggattatgtttctaatgcatgaattttgaggcacacaaaccatagcagacctaggcctttcatgggagggaatacaaactagaggcagacataaagctgtgtccattaaagaggtgaaatacattatgtgcattctactcactgggtaaccagcaacatactggacctgagtataagaagaaacataaaaattgtgtatcttgtaattccaggctttgagctgttttcagtctgactgatgagacaaggtttgtgccagtgaaacaagtagagattaattcaagacagatgtgatcaccagtctctgctggcataaatcaagtttcataaatgactgaactagcatttgaaccaacatttcttcttattttcatcccagtagcatcatcctaatctggtgaccttaaaggcttttaaaaatctggttattactagaaaaatgttgcctccatctaaaagttgcaataaagctttctttccctgagaaaaatctagccagccctttgtgtaggttgactatagcgggcatgtgcccagcatcattttcctgatggttcattctccctcacccaatactgagccttctccaatctagggaagtggtaagtccatgatccaataaaaaacattccatctacatgacacagtggtcagttaaaagactcaagttggtccaataaaaatccttccctagaattaacttaaatacactaaaagacaaaatttactttccaattgaggttgataagcttggaaaatatgaattagggctacttgtggccatgtttctcaccacacagagagattatttcccagaatgaagccaaacaagatagcaggcagaggagcaacagtttttcatcctcagtctcatccctgaaggcaggttcctactgctgtcccagaatccctcaaagctcctggactaatacattccccatttgcttgagccgattaagttggatatctatcacttgcaaataagtgagtcctgactaatatgttggcttcacagtgccatgcccagtgcatcttatctgcacatctccattttcctgcagaaaaacgaccattggatggaaagggctgtgaagctctcctttaaagtacacattcctgggcttaaccccagacttactgatgcagaatctctggggataagacccaggtatttgtgtaatgctaccagtgattctgttgcacacacagtgccaagtttgcagcatgggatcaccacatctcattggctgattcctggagtctaactcccctggaaaattttgctctggccaggtatcacactttaagatgaatactaaagggtgctatggttttaatgtgtcccccaaagtttatgtgtttgaatcttagtccccaatgcaacagggttgggaggtgggacatttaagaatggattaggtcataagggctctgccctcatgaatggattaatgttattatcccaggaaaaggttagttattgtgagagtggacttgttataaaagtgaattcgacccccgcttgccctcttccttcctcacactctcttgccttttcaccttctgccatgggatgatgcagcttagatgctctcactagatgcgggccccatgaccttggactcgccagcctccagaactgtaagaaataaaattattttctttctcaattacccatctgtggtattctgtgatagcaacacaaaacggactaagacagagagcatgaccaggagaaaaccaggtcagtgagggcactcgcgctgttcttcctctgatgtgttttttcagaaatcagggtgtttaacagcaaatccacaagggatattctgtcttcaacggtgtgaaaactgtcatgtggaagaataacagattgactttgtggtgttccagaggacaggccttcaaccaagggcatcctggtgccagatttcagctaaataaagggaagaactttctggcaattagagctgccccatggtagaagtgctgccacagaaagtagtgagctgcctggctcagccgtgtgcagacatcagcggctcaccatctgtcagttgctctggctggggctgttccactggacagaaggctggacgagctgcctttttcttgccaggattctacaattctagaacgtggtctggggacaaaagaggccaggattaccagaggggccaagtgaccagaaggggagagatgtacacgagtttgctgggaaggactcatgtgagaaaccaaactcaagatagaccttgtagggaacacaggtagcattaattacagcacaggccagcactgaagtcaggaaattttccactttttgtaacttggttttatttcactattattatcatgactgtgaattactgttagaaggaggtggaaaatcccagatatttccattttagaaaaaaataaagtcaataaactggctgaagcctaataataaatattcatgtcattgaatataaacaaggagagtgaaggaagggatgttgtgaatgaagtagcttccatgtcaagaaaagcagagcactggggccgggcgcaatggctgtaaccccggcactttgggaggccaaggagggaggattgcttgaggctgggaattcaagaacagcctggacaatgtagtaagaccccatctccacaaaaacaaacgataacagaacaccatggtccaggaggcctcattcccgtccgtctcagtcctgctcccttggtcctcaatgtcagagtgcccaggagaacctgagttatgtcttcactcagggtttctcaacgtttttccagcccaggcgtttggaaacttctctaagtatgctactgtatttctgcagcagggagaagactggagaccatgtaccgtatcagcaaccaagtaggggaagggagagggacagagacgcttgaaaggggacatctgactctcattttgcagaggaaggagaaaagagccgatgcatataatgccacccccatagtcaagagataaggctgcacagtggggctgggcacagccccgtggagaccgataaatcactcagaactctggaatttgcaagtgacagaaactgaactcaactagcttaagcaaaacagggatttattggctcttgcagctaagaggattctgggacagctcacagaattaaagaaaagactgtggggaccaggactttgggaccaattctgtctacaactccatccatgagtccatccatctgtcgcctctcccacacacccctacccagttttcatctgtgcttgtctctggtcgcagacaggctctcttccgcactgatgaagacggccaccagacacctcacattcacaccttcccactcccgcatcccccgagaaaagttcctgctggtaggatccatggcccaatctcaaaggaaggactctgattggccctgctctcatgccccccacccccctcggactgattacttttgtacgagggataggccctgtgatttgtcaggcgtgggttccatgcctgtccctaggggctcaagaagagtgaagggccttaatagcaacctctactggggtctagggtcagccctgggatgcatcaggggagtgggagggtggtgaaggaggatcttggagcaaagaggaggggccgctcacctccccctgggaaagtcctcgtgggctgacagtcattgtgggattccctccctcacacctgctgacccatgagtcgggcggctctgccttcagtgtgtggaggggtccaggcaggactggctgagggcagctcaccctggccctcagaggatgatgcttggtgaggttcagcctccggatacacacacacacactcacgcacatccacacagatgcacactcgcataccctcatacccaccagacataccctgacacacacagaaatgcatacacacacacactgacacaccataccctcacaaacgcactcacacttgtagacatatttgcacacaatcaacacactgacatacacagacgcactcacacactctcatgctcaccagacacactcatacacgtgcttattccttcagatacagacacatgggcgcctattcaaacagatgcactcacactgacacacacaatttacagacacattcatgcagatgcacacttacacatgcaacactttcacaattcacccacacatactaacactcagacacattcattctcacacgcactcactcagaccactttcattcactttcacacattcactcacacatgcacattcacacacacacattcagtcacgtatgctctcacccacactctgactcagtctcacacatactcagatgttgtctcacattcacacacattcacacacttgctcacacacacacacgcactcacatatggtcccactcacacatacgctcacacacatttgcacacacacacgtgctcacgttcacacgctttctcacatatgctcttacatactctcacacacacactcctccgtcacgtagtctctttgaaggtccagatggtaccccccactgcctccacacaggccttactgagagcacattgtgggtttgctcccctggctccacaggggacacggggccacctggctgcatctccctcctggctgggaaagtctcacactgtcccctccactcccctccaggcaggatcaccttagcctgagcatcccagtgggaaagattctgtcttgtttctaaggcctccagagaaaatgcccagggaaagcaaggagagagaagaaggtgtctctaaactgcctggcagccaaaagcacatcctcaatgaaggtgtccctgtcccgtcgccctgcctgagaattcctagactgtggttgcaactgtgcacccccagaccatctctgcaccctctctgagtccttctctccacctgcttggtggaagtcaacatgcctgcctcgagggccacccaggggacaccaggagagatcaaatggcacccagcacagagctgcccactcagggacaggtcgacgaggtcgactccatttccctcctgcagagatcacagctgggagatggtggactcccacgtgaaatcagaggagagcgatccctgggcagggtctgccttgtcagctgcatgatctgtcctggctgaggcagggaacctcggatcattaccaccctcaaagctcactccccagagtccaaaaaggaaagccactttaactcccctgcgtggtttggaaacccagacatcaaagcctttcactgcctgtgggcattttctaccccctccctatgctcggctcttcatccacccttccttccccctgcaggcctcctggccctcctcagtgggcccctatgcctttgctcttctccctcctggaatgcccttcccctcctccgctcaatcaacaagacctttccaacagtcgtctctgccatgaaacccctgcaagccacagtccctcaaccctggttcctaaccaggccctccgcataccccctagcctgtcccattgcccccggctggattttggcttaggatctagctccaagagacccaggtcctggagggcacaggtcttgtgtagtggacccactgctacagccaggcctggctcagtggcagggcacatccggggtccctttggatggcactgaagaggccacgtgaacggttccctcattcccctgggaatctgtctgctcttggtctccctccaaaacatccacttctcctttcagacaccatcccttttctgttagttgatatttatgggtaataagccaagcacatccaagccgaggtgaaatgcctcttgaaataaatactctccccagcaaacaggtccatccatccaggcaggatgggctttgctggcagccagggaagggcaggcaggagccctgggagcaggagggagaaggggcttctggggactctgagggatgaaatagggtggggtacggggagaggtgggcgcgtcaccgcatttggcactgtcatcaaaagtagaaatggaaggtatcgcttctcaacccctcagactcccatcacggcagagatgaagcaggtcattttaaaggctggctctggagtggcaaagacagaccatgcagtgcagaagcctctctatgtaagtggggagggtgaggagtcaaggtcactgaaagtcagcaaagcctccgtccatgagtgctggggctaggatggtgctaggacatgaggggagcctgggccaggctgcagaggtccaggacatggatggggctgtccatgtgagctggggctcatcagaggtcatcaagccccctgcctcacctcttagcgggaccacctcactaaacccatcctcagtttatggcagcctctcctggtgtcagtttcttctcagggaaagggtcattcagtggggccgtgcagggcaacactgagctccacacctaagggatggaaaaataactccagcttctaaatatgtcccctcccatgaggactgtagcctatttctacttccggaggtgacctctcctctgttacagattcataggacctggtccgtgcagagagcttcaccccaacacacattctcaagtacggcagataaacaggtattccagaacacacacacgcacaggcatgtatgcacttacacatgtgcacatatacacatgcacatatatacatacacaaacatgcatgcacacatgtatacactgtcaaactgctcatagagatccaaagctccacttgcacagccacacaatgaaacaaaacaatcccacacttcgttcctactcttaactgccagaaaagctgggggtacctttcagatgccagggacaaaaccaggaagacaggcgaggctcttcttcacccacctaaattccttccgaccatttctcaaagacccacagcccagccttttcatgctgctgcccttcactcttgcaggggacactcatggagcctgagactgccaacctcttccccaaagcccacgaatagaatatggaaggaaggaaggaaggctcttagacaaagaggtcagggtccacttctccgtttgatctccccagctgcaaaggggcagttcagagcttgctaggcctgcctggcaggggaggggaatgaaggggtgagaagtgaagcaggcagccagcagtggccagcatcctctgcggcatgaatatcaggtcatgaaatgcaattagggctgcttgtgcctaacctcccttcctctgcagctccccgtgacttggcagactatttggaggacgttccaagctccattagtttagcatcctttgaccttgagggtctgctactgagcacacatccaactggctgccttccatctgcactggggcaagtagggaccaggctttgtcacttttctgaagaccaagctcttggctgaaccagtctcctgagggtctccatcatcctcccaggctacaagtgcctcttgtgtttcgagctggtgagacctcctctgcccccaagctctatggcaccaagatgacctgcaagccactcctctcctacagagtggactcctccacacgggaaagggctaagcagcttccagccttttgtggagtaggtgtttgataagaagtattgcattcgtggatgaataaacgcacagccctggaggagaagcctcttcatgctcatctcctttattttcttctttccttctcctcctgaaagtcatatcctctcctgcctgtaagctcaggtgctgtgttctacctgcttgccacactactctactgagcaggctcccgctgctctggaggacacactccagtatctgttctttgctttcttctcatgtcatttccttttcctcaggtccactcgggaggagttaagatcaggattggaggaggggccctgccggtccttcctcctccacacactcctcacctcaccccgcagctggatagaatagtgcctctagctggcctcgcagtgtccggctgtcatccactcgacagtccccagggtgcttccggcccaggacgccaggctctgcacggggatctccaccccaccaaccccgcttgttttctgcacatccataccatcctggctgagtctgagaactggccacaatgaaatgcatgacagaagaggaaagagccttccccaaattgtcagactgagccccagcctcaagtacagagaaggggataagagaatttcacccttgggtcttctcagccaaaaccttctagcactggaggcaagaggaggagaagacaaagaagaagggatcctcttttcccccaaaacccggtgctgacttgagcttccccagccctgcctcccaggacagcatctcacctttcagacctctccctaccacctccttcctgcccacttagaaacctgctctaggttaaccctggaaaggaacaggtaagtaattcatactagagtgtgtattactagagtatgaatcactcaacaagaacttgatactctcgccccaggtgtgtcttcctgtgacaggggctgatgttttcgacctgggaaggcaagtaacttccatctcccatgcccggtctagctggccccggctgcctagagcaccccgggaagactaggaaagtcttctgaagccacctctgggctcaatgagaaagagtacgctgatcaattggtgatgtctgccatggacacaggatggggagagtcctagtaggttcactcggtatttgacattccagatttaattcaaaaggacttatgtagtgaaattccagaactgtacatgagccctgctctaattaggccaatgaggtgagcaaaggctggcttggccaatcctggctgtttctcccactccccacctgccgcagttggctaaactgaaatcagagagaaggatgctctgctgcagccactgggctcccaaaacccatgcaaggcacactggaaagatgggcaaccactggggtcaagcaaggctgaactctctctgggccaaaaaccgggtatggatgagtggccatggaagaactctgcccttctccgttcaaggtcagggttgggtgaggtatgtttctgatttgattcctccagcctgaacagtggttctcagatgtcaccgcacatggaatcacttaggaagctttttaaaaacagatacctgcgcttcagccccagaaatgctggcttaactggtctggggtgcagcctgggcttacagaaatgttaaaatctccctacgattctaatctttcagccaaggtcgaggccactgggctgagttttgagaaatcgtttaggccagtgtttctgaaactaatattcattcaaatcacctgggattgtgttaaaatgaaaacttttattagactggggtgagggcccagagtcttcatctataacaagctccccagtgatactgatgctgctggttctaggaccacactttcaggaggaaggatttaggccactggttctcagagtgcagtcccctgacctggcagcctcaatatcacctaggagctccttagaaatgcaccttcttgcgttctatcccaacctactgacttgggaacttgggggcacacacaagtgtgggaaccaatggtcactgagaggggccagtctcctgcttccaggacacacctgttccccaggtctgcaggatgccttcagaagagccctcttagatacagctcccttcctggtccagccagatgtgtgtttgaggggtggtgagaacaagtgtaaaggaattaatgagtccatatgtcaatttttggccaggaataaatgcacacagtaaatgcacaaacgtctagttttccaaccctgagggagaaggaaaaaagacacctgaaaaacaccagcaatggagagatgaaattcaattccaaactaaaaatacacataatttatcattatctagaaggagattgggtgaaggccattagcgggtattttctggttgatgctgctctcaacagcatgagtggcgagccagaagggttactgccctacatttccctttgctgcagttacgcagcaacaactccaatgcacagaaggccccatgctgcttcctcccaccagaaatgatttcccattatctagtggctggtgggtagagggcatcagggctccaaaggtaccagcctcctgaggggcaaagccacctctatttctcagaaaaagaacttaaacccagcagggctgctgcagacagactaccccgggggcaggggcccaggggtggtagcggggatggagtacttttccacagcgtcctggcatcctgggtctgcccaggaaactctaggggcttgggcttggtggagaggaagcaggagcctccaggatgactgtggctgtccccacctgtccacttcctgggatgcaaggaggctttgcagaagaatgtaagtgctgttgccctgacaggcagatgtgaatcggaactaacctcagaatacaggggaagagcccaagagaggaagtggcaagtttcatgtacgccaacatcctggagcacctgctgcatgccaggcactggggacacagtaaggaatgggacagagttcctgccctcgtgttgcacgcaacccaacagccacctggtcaagctgccacagatgtgttcactcatcggtaaggaccaggatgcagcctagctgttgggtggcaaggacacctggctcctggagctgccatgatcccaaatgaccttcatcccagtctccaggatgctggctgcatttctcttcctgttctttcctgacagtctggctgctcccagatccccatgaggtttctgtcttcgtattgccttgtctgtccataaaccccattacatgaaatagcctgtgtcagcctccgggcctaacaacctaaagcacctcttatcagctgtaggtcaatcccttaaaatgctgttatgaagacaaaatgaaaaccagtcaacaaaaatgaagagttgaaggcagcaagtaaattcagcaaatggaccctttggaggactggccatggggtgcactggatttcaggaaaatgacctttgggaaattgggctacctcacctcaagctccatggagccccaggtcgcttttggtcttgggcaaagtctcttctggaagccaggcaggtgctctgttcctcactcagccccacaccctgtggcttcccagaaaagacctcattccagctgtagattatacccagccttgactcactgaagaagttcagaaaagactttggagcctcgaagaatggaaaggggaaggaagagatgcctgagaggacagcctgtgaatactgtcccccagcacctatttaagccacgcagtggcacctcctccccacaacagcagcccccagagaaagctccagctgtccccagcccttcttttcctgcctgatcacgcagggctgtcagggcaccggttggagatgagggacaagccagggtgcgcacctggcccactaacaagtcatccccctctctgtgcaatgacaacccttgtcctatgaattacgttttttttttttaatagcttttgacaaatggggtacgtatacaccatggaatactatgcagtcataaaaaggaatgagatcatgtcctttgcagggacatggatgaagctggaagctgttattctcagcaaacgaatgtaggagcagaaaaccaaataccgcatgttctcacaagtggaagctgaacaatgagaacacatggacatgggcggggggggggggggcctgttgggagttgggatggggaaagagagagcattaggaaacatagctaaaaagaaaatagccaatgcatgctgggcttaatatctaggtggtgggttgacaggtgcagcaaaccaccatggcacacatttacctacataacaaacctgcacatcctgcccatgtactccacaactaaaaattacaattaaaaaataaatagcttttgacacctggtactgctcgtcacaattagtcctaagagtccccaaactccagccagtggtatccctaattattggtgaattattgaacaccagtaattcactctgctttcctgagctcaatctttgagggcaggagatggcaaaggtctaggaaatgacttaagaatcccgaaggagacccaatctgaccccctgccaagcctcccaagtctaccgtgatcaagttcctgctctcacctcctccctgagactgcctggccaggggtcatggcagctgccagctgctgggtagaacagaaccttccagccctttgaccccactcacctgttctaaaagggagcagacgcagtgttctctctccctgcttctcgcaaggtcacgtgatcccatttccacccctctagctgctccctcctcgttgtctttctttgaaagaaaaaaaaaaaagcaaccttaatgaggtataacttaaacatcataatattcaccactttaagtgtacaattcaacaaattttaatgaatgtgtcatcaaaattgctccaatttgatggtcctcttcctctgcctctggataagagctggtcttcgtgccgcaccttctgtgcccgcgacgacacgtgtccagaccttgccgctgagttccagggacctcaaatgcgggacgtcacaaattccactcaccaaacggactcctcctctgcactccctaccatcgtggatgacactgtcacccacccagtgcccaagcagacaccacccagccatgacccaccatccttaacgggcctagagctcatgctctgctcttgggcgacgctggccaaggccaccatcatcactctgagctgggttcccacagcgctgccacctggtcttccttcctgcagtcccagccacccacccccacctccagttggccagcaaaggcatctaagacacacatgccatcacgctgtgcccggtttaacatcttttttgagacagggtccaactctgtcaccaaggctggagtgcagtggtgcaatcacagctcactgcacccttgaccttctgggctccagcgatcctcctgcctccgcctcccgggtagctaggaccacaggcatgcaccaccacacctggctaattcttgtattttttgtagagacagggtttagccatgttcccaggctggtcttgaactcctgggctcaaatgatcctcccacctcagcctccctagtagctgagactacaggtgcgtgccaccaggcccagcttttttttttttttttttttttaattttttgtagagatagggttttcccatgttgcccaggctggactcaaactcctgttctcaagttatccgcctgtctcagcttcccaaagggctgagattagaggtgtgagccactgtgcccagccttcacatcatccagcagctccagtgcctggggtaaggtccagtccccatgctaaggctctgctgccaggtgtttggctgaggtccccttgtcacctttggaaatgcaacagttgtgggtggccccagtctctgtcccaagaacatcagcccagacccttggtcagaaaagactcagaacagattcagagaagccaccagttctctctgcctcacagtgtcccactgggtctgccaagtctaattccgaattgtatgaactgaccactggtttgggcatcgactcgtccaagcttcagagacaaacagcacaggtttctggggccctcaccgcgctgtagctcccttacctcatccacgtgccgggactaatcgacagcttagcctccccactctcaccggttgcattaagacagagagagagcagctggctttgcatctccaatgggttaaaaaagagaaggcaattccatttacaaaataggattacaattttgcagaatcctgctggggcctgggggaaactttgaaaacacattcattttgtttcatccttatcagagccacctgctctcccttcccccacaccagccatcttgattactcagagaccaaggcatgagcaggagctgctggtaccccagcctgcaaaggtgtcgctggggctcctcagccatttggactcctggctgggaggctcacgtcctcggtcaataaagtgcccctctggagagacagaggcaccagcagctttcccaccacagcaggcctgctgagaccttggcccctccccgagacctccacagaaccctgaacctacaactgaggaggaattgatcttcctctgaaactgtttgtctacaggaaaaaagaaacaagccaaagaaaagcaagggcaagggaatcaagttattgcgacaggtgttcgggctcccgaaataataaacatgttgggtaagttgcagtctcactgtggaaggactcatcttgatgcaaagcctttcttccctgcaccagagggggaaaaaaaccatagtaaacaggaggtgggggaaatcaattcctcatgcacgttgctcattgaatgagggaatctcaacccaactctgtcctttcctgtcttctattaactttgtcaatttcccacctcctgagttgctggctttgcatgatgaggtgggtgaaggtttggggaggtgagctggagaaagttgatggccccttgggctgggccatggccttttaactctattatgttgggatggggggctttgtctccagattggctgcaagaaatcacagaaaatgagggaccttagagagcacctatttcaaccaccttattttacagattaggaaaataaatctcggggagtttaaggtctcacccaaggttgtttagccatgagccacagaggcagcccataaaagagctaaatgaatggcgagtccagtgggcaggtactgccccggagcagagggaagcgcttctgcagctccttggattttgttgcctgaggtcgaataaagaactcttaaagggataatggctcagtaactcaggtgctaaagtaatggaagcgagagggaagatcacctcctgactctcaatctctgggggacagggggcggtgggaacgagaaagaattgatgggggcctcctcctgtgtccctgaacaaacagagcacttgcaagaaaagtgcttaggaactaatcacccctacgagtgggaggggtgcccttcagatggtaaatctccccattaccaaggacgcttcctttattgtggattcgcagtctcctcagagaagcatccaaggagcttggcatctcccttgctcctggtgagaccggaaggcaggctggtccccagctcttcagagtggagctgggaagagctgcagctgccccaacgctgggaagtcaccagtccttagggttgctacgtttagcagatgaaaattcaggatgggccaggtgtgatggctcacacctgtaatcccagcactttgggaggccgaggcaggtagatcacctgaggtcaggagttcgagaccagcctggccaacacggtgaaaccctgcctctactaaaaatacaaaaattagctgggcgtggtggtgggtgtctgtaatcccagctgctccggaggctgaggcaggagaatcacttgaacccgggaggcagaagttgctgtgagccaagatcacgccactgcactccagcctgggtgacagagcaagactccatctcaaaaaaagaaaaaaaaaaaaagacataacagccaggtaaatctgaaaaacagctctaactgcctaacttgtaatgttttggtgagagacagctaaataatatttagggtgttccaacagggtcaatatgggtcaaaggacaacatctgttagctcagaagaaatctgtcagcacagagcatatgcgttggccgggcacggcggctcatgcctgtaatcccaacactttgggaggccaaggtgggagaatcgcttgagcacatttcaaaaatcagcctggacaacatagggatatccctgtctctacaaaaataaaaaaaaaaatgagccacgcctggtggcacgtgcctgtggtcccagctacttgaggggctgagatgaaaggattgcttgttgagatcaagggtgcagtgagccgtgatcacgccaccgcattccagcctgggagacagagcaagaccctgtctcaaacaaaaaaaatgtgtatacacagggcccctggccaccgtccccgctcgaaaccccacgcaagtgtgtgggaagtgccctgccccacacacagtaatctgtctgctcctcccagggtgaactccgtatgaatgacagcctggcagtctgtgtgtgcttccccactagggtaggggcccagaaaagggctctccaaagtgggctgataacattttggactgttaagtcttttcatcctagggggccttcctggtggaagcaggcttcaaagaaagatttatgtacaccacagagctccagcatctcctacatttaaaagtctgggacactctcaaaggaccaaataagttgcattggaacaaaagtgacaaacaggaaggcgggataggtagggggcgggtagtgccatggggcttggacactgtggctggcaagtcatttcacccttctgaaactggtttttttaattttatagttaaaggatcttgttatgttgcccaggctgatctcaaacacctgggttcaagcgatccccctgcttcgcctcccaaagcgctgggattccactggccggcttgaaaccctcttatttgtgggatgaagactgcccagcccacaggttgttttgaagatcacatggggtgatggaaataaaaatgctttcaaatagcaagctgcggccgggcacagtggctcacgctgtaatctcagcactttgggaggctgaggcgggtggatcacgaggtcaggagatctctcgagaccatactggctaacacagtgaaaccccatctctactaaacaaaaatagaaaaattagccaagcggctactcggaggcagaagaatggcgcgaacccgacaagcggagcttgcagtgagccaacatggcgccactgaactccagcctgggcgacagagcaagactgtctcaaaaaaaaagtaaaaaaaaataaaaatagcaagctgctacagaatggaatataagctcctaataaaattggacatgacctgacaccgagtaccaagctaaacacttcacgtgctttatctcagcgcctctcagttaatctcatcgtcacatgcctatggggccaatccataacttcttcactttgcatctgtggagctcagaggtcttgtacggcctggccccacagtcggtaaatgaaacacagaccctggccgggtgcggtggctcacacctgtaattccagcactctgggaggccaaggcaggcagatcacgaggtcaggaaattgagaccatcctagctaacatggtgaaacccggtctctactaaaaatacaaaaaaatcagccaggcatggtggtgggcgcctgtagccccagctacttgggaggctgaggcaggagaacggcgtgactccgaggtggagcttgcagtgagccgagatggagcccccacactccagcctgggagacagagtgagactcttgtctcaaaaaaagaccctgattccaaacccggtgttcattcattccttgttcaacaacgattcagcaaatgtttgctgccatcagcagagttcagggtatcaaaaagaaagcagtggatgggagacacccactcttgctctcataaaactcagtctattagaaccatcaccacaggagaaaggataattttccaagcatttacaaggcaccaaggaccgtgctaggtactttccatgatataggaactaatgttattcccattatttcaatgaaaaccgaaattcaaaaaggcgaaatgataaacccaggtcacacagctacggtggagcttggatttgaacccaagtcctggactccagaggccttattctcccttgctgctacgctagagaaacaaaaagctttcattgtgatgatttaaagcttaaccctcactataaggatagtgaccccatatattaccatgttgtgtctggaatttgtggattcttggtcttactaacctcaagaatgaagccgtgaaccctcgcactgagtattacagttcttaaaggcggcgtgtccggagtttcttccttctggtgggttagtggtctcgctaagcttcaagagtaaagctgcagaccttcatggtgagtgttacagctcataaaggcaatataaacccaaagtgagcaatagcaatatttattgcaaaatagtgcagagtgaaagaacaaaccttccacagcacagaaagataaccaaacgggttgctaccgctagctccggcagcctgcttttattctcttatctggccccacccacatcctgctgattggtccattttacagagagcccattggtctgttttacagagagctgattggtccgttttgacagggtgctgattggtgcgtttacaatccctgagctagacacaaaagttctccacatccccactagattagctagatacacagtgtcgattggtgtatttacaaaccctgagctagacacagagtgctgattggtgcatttacaaaccttgagctagatacagagtgccgattggtgcattcacaatccctgagctagacataaagattctccaagtccccaccagattcaggagcccagttggcttcacccagtggagccgcctgcccgcccggcgccgttcgcccgcactcctcagcccttgggcggtagatgggactgggcgcagcggagcagggcgcggcgcttgtcagggaggctcggaccgcgcagtagcccacggcgggggcgggggcgggggcgagggcaggggcgaggctcaggcatggcaggctgcaggtaccgagccctgccccgcggggaggcagttaaggccctgcgagaaatcgagcgcagcgccggtgggccagcactgctggaggacccgacgcaccctccgcagctgctggcccgggtgctaagcccctcactgtcggccggccgctccgagtgcgggacccgccaaacccacgcccggggaactctaccagcaagcgctgtgcgcagccccggttagcccccgtgcctcttgctccacacctccccgcagcctgagggagccggctccagcctccaccatcccaggaaggggctcccacagtgcagcagcgggctgaagggctcctcaagcgcggccacagtgggcgccgaggccgaggaggcaccaagagcgagcgagggctgtgagggctgccagcatgctgtcacctctcaatgtcaggttttcagagtctaagtttgtgaaatttagaaagaagaggagaatcgctgggtatagatgtaaaacaatgctttgtaggaaggatctaacattttctttcaggatgagggcaggagtgcgtatctgaggctttggctcaaagacaaagagggagagagagggcttcacctcatgatctacaacatttccacgatgtaccaccgcgtcccggctccccgatccccttggaagaattcgttctctcggtcagagcgacctcgcacgctgatcggtcgagggacccgccatgctcagggctcagcacccccgagttaaggagacaagagcagccatctcccggcccccaagcacccggactcacacccgcctctgctgcgacttcaccaaggaaggaaaaatggctcgaaatgcctgtacattaagaagcgtataattatgcataataaaaagacgccggcccttgtgtatataaacacagctttgactgagtgccttctcccaggcagcccttctggctctcaacagcagcagtggaacatcttaaacatatggtcgccatccaggcctccaggcagatctgaactggggagggggtgggggcaggggcaggcgggaggtggagacgggacggggatacaggaaaatcaggagatggttgtttggggaagagggttacacggagagctggtgggccaggggtcagacatttacaatcaggacataatctgtgacctgccaccccaagttgagctgtctttctctctccctcctctgccccaggctcaatttgcccccaaagacaataatagggagttctgccacctgtctccggggagcgggaaggagagctgctgagtggcaggaatatttcctggttttgatttggggatcctctcatttctgtttgcactgatttcagcacctgtcacctgcaaggcgctgagtaggcaaggagggaatcccccagtggataagccacttccgatggtgtagcagttcaacaggtgatcaaagacacccccaatttcagtcaagctcccaaccttgggttctccagcctcaagctttgcctggcctgcccatcagggtgtggtcttgctgccagctgctcctgaccagggtggtgagtcttcaggctggtgctcagcctcccccgggccaacccggagtttgtgcagtgcccctcaggctcctggagaccccatgctgcaccatgaaagggcctgctcaccacagtagagggctctgttcctagccttccccaccatcaccgccacctccccacacaatccatcacttctctgcaaagctggacagcggagcaaagctggctccgaactgggaagctggggagccagtggagctggtctgcgcatcctccttgggccgtcactagcaggcctgtctcaggcagatctgtggtccagctatgctgtcgctctatttggggtggggggcggtgaggaggaagtggatgctggaggggacagtgcttggtctcctcatcctgcagcatatgtagagtcctctccacaccccagacaaactggagatgctggtcctgaagcgaagacttgggtgcaagtgttttatttgggagatgaccccaggaagcaggagtgaggggcaggaagagtgagactcggaagggagaaaagcaaggaggggtgcattcttgggcttgtcactactgtggacaatgggactcaaccccactgggacccctctgcaaagccaggcatggggtgccttgtaatggttcctctggaagaccgcagactaaggcattttcccacgggcccctgcccatgggctgaggtttgattctcctgcttttccaactgcacctgcagggacactccttcctgctccggggacagccccaggcagagactcggggtgcacttgaggttgggagatggtttcagcatgcatggactgccccccacagctacagacaaatcagaagtgggcgaggcatgcagactcagagcacggatgggtgagtgaatgaaggagtgaaagagtaactttaagacagtttcagggcgtggacctgggagtgcaaaagcagcctcctctctgcctgaggatcacctctgtgtgagcctcagctttgtctctggaaaggggacgatgcaaagccacaggcagagcatcacagccaggacagcagggatgcgctaagagggcactaggctctgggagcaggagaaatggctcaggcaggagctgcaactctctggcaccacgctaaggagttaggactctattttctaccaatcacaggcatgtggggacatcctcctactagcaaagccaggagatgtacagtctgtggcttgtgggaggcaggcgtcaggtcagggacaacccctgccaaggagaggtaacgcccacatcccctccactccctccacccacacctgccccttgctgtgcagacacaccctcatgctggccgtgacaatgagaccaagaattaagtccctgggagtcagcaaagttttctaaggaaaatgtggagatgatctcatattagaaaaatcagagagttaacaagagagcgtctgggaggagggaaaggaatcagtgtttctcagctagctggcaccagactcccagggcacttgaaaggtattgggcatttttcctttttgctatgaccggggagggcactcctgaatcaagtgggcatgagaggcatcctgcgatacacacaacagtcccccagcagcaaagagcggcccgctcagtccaggggccagtcacagttggtaaatgaaagacagaccctgattccaaacccagtgttcattcattcctttttcaacaacgattcagcaagtgtttgctgccgtcagtagagttcaggatatcagagaggaagcagggaatgggagacacccactcttgctctcatagaattcacagcctattgcaaccataaccacagaagaaaggatcattttccaagcatttacaaggcaccagggacctggcgcctgggaaagccaccaggcttccaggggcccctgttactctcctcatgacccaaatgccacagctcccccattgaacacccctgaaagaacacttagaaacagcccaggggaatgatacaggggggttgcaggacttcccattcacccaggaagaggagtgggaggcaggtaactgagaaaggatggcaaagcttctaggctgcatgcccagccggctgagtgtttagggatacgagagaggacagcaggtgaaaggtacctgaaatggggttagagggagacagtcttgatgtgcagttgtcacaggaaaccgtgaaggagctggtgtgagcactgctgagctgggccgggtctctgcagaggcagaaacgagagatgaacaaacagaaccgaccactcctttcggacccctctgcaacatggtcgctgcagctcgggcggcactggacaggtgggcgccacagagcgagggggccggcagagaagggtgggactcccttgcaattctgacatctcccttcagctctccatccagagagatgtttttatgtaagcagtagccagagagggattggagatgctaattccatttcattagatcccagcagctttcgattacagcaggccggagggaggaaacagagccgatgtgtttttagaagccgcagttttgttctgtttttaatttaatgctgctggtcaaaagatgccaccttggagtcgctaatgattcgcgtgaattattttggttgatttacacaccccttcgactttaaataacaagggaggaaggagagctgggtcccccctggagctgtgagcctgcagctggaagaggatgctgccgacttgagggtttcttttttttttttttttttcaattgtttcctccgtgcggggctgggccctgggcatttataaacagggcacaaacttgggacaccagacaccgtcccccttggaccactgccctccaagccgtgtcttgcctaccgttctttccccaaaaaaagccagtggttagtgtattagagttggtacaaggtgtcagacttaggacgaagatcttatatgcacaaactctgatgctcacatttatgctgagaattagtgtgacattccctgtgtccctgaggaagaaaacaaagctctgagtggtttaggagcttgctcaaggctgcctcactaggaagtggcagagacagcaaccaaactcacgcacagcagggcctttcgggtttggttcagtattgcacctggagtcctacaggaaatgaaagagtaatggacccagatttgtctgaatccagagtcgaagcccttcccatttttctggaggaccagtggtctccaaagggactgggctgaccagaaaggccaagaccaaaggctgaagggagtggaaccctcccttccagacccccagcatccgatgggcatctgagcagcagcttcacccagggccgcctggcaggggtttgatcatgtgcctgtctgccaggaaaacagtttgagggttggaacaagtgtccaaaaggagccttcatttatcttgattcccagctcatctccatcaggggaaacgtctcctgtctgcccctgcccctctcttttttcttcccttcaaaataaaattagaggcagccgggaagagcattaagtcctttccaaatttccctttctcatccgtcatgtccaggccggagcttcgaggctgcactgggaagtgagggtctctctgctgggagcagcaaatggcagacagggggctggcaaggagggaggaacccagctcaggtgaccagggagaggcctggcttctccatcatcaggcggtcagggcagctgcatatgtgattcaggccagcaggaggctttgaggccggctgggccaaggcaatcaggaaaaccaccagaatcaggaggagagaaatagaggcccccggaagcctcgtgactttcccatcagggaggagcaatcagtgtatatgcaaagtgctgcagattgacatcacaggcatttcatccggggactcaagccgggagaaacagggactacaaaggtggaagtcccaggttcaaatcccagctctgctacttactagttctgtggtctcaggcaagttattgcactcccttcaacctccatttgctgatgaaaaacaaacccggcaggaagcggatggcacctgccaacaggctgaccagagggccttaaccaagggaccaggagcagctacataaccaacagatctggagcaaagtgaaaatgtgagccccatggttaaaaagtgttaagaatttcaagatgataacagcggagcattagaccaggaatgggcccttctaagcgccgggcccaggatgacgtcatgggtcacaggcccacaaagctggccttggaaggggctttttaccaagatgtgggcagggtttagggaaaccactccttgtgcgacaagtgagtggcctggagaaagcatagctgtcccttcgctgtagaaggcctcagaatgggaacagagctttgacaggggtcggagggctggggaaattcccaccctctctctgtgacctgagtcgggagcctagtgatgcggtccacggagctctgcctccgagcgcagagcagcgggagaagggctgagggtggctatggggatgagcagctatctgcctcgctgggaggacctcatgaatgtttgtgcatgaaggcgtctagcacaaggaggccctgtgagagctattcagcttcttcctggagcactgatgactttcttgttcctctgctctaacttgcttcctctcttgagggtggacccactaggagacgtctttccactccctgtggcatctcccagctgagaacacagccagtacctaggtaatggaagtcattgaatgaatctggttgtgagtgggagccaccggctcaagctctttcacagtgaatctggtgctgccctggaatctgcattccctggtgaacaaggacaaggagggagacaccgagcaggccagtgcccaccaagctctgagtctcatatgtcaggtgcaagccgagccccgcaggacacagcagccacaccccaagaggtaaagaaagggactaggatgaaagtgagagaactaagggcagagctgagggggctccaggtggagggtgaggctggtaaaaattggggtgttccggaagccagatgcggtctgactccctcctgcaacccctcaggggaagcccctgtgaggggcacaaacactctcagcactggaaaccatgcggtcacaccgccaacatgttagccaagtgccatctgcctaggaacagcctccttctgtgcagaaagcttgtcatgcctcctggtggtgccagctgcaggctgtgtgcttgggcagctggcactacccttggacctgctctccccttccaaggaagacagtgaccttgccaaggtgaaagtatgaaaccaagcacagggctcccagatcagaggtgtggctcagcaacgctctaaaattgggtccagctttggaagacccagtgtcctctctgctggtcaggcaaggtcacaccgccaggggctcagctccccagatgccctctgtgcaatgctgagccctgagctggtgctttacttctccacatatccacgctctgcctctccataatcacggtttggttccctaagaagcagttcctgagcggatttgagcacaaattgtttatttgagaggtactggctatggggggagccccagcaggagagcagggaaatgacccagagaagggaaggcagccagggaagggctgttctaagcccactgccaaagtgggcactagggctgcatcctgtgaggaaactgagaaacaacgcaaaacacaggatctggaaccatccactcccaaacctacataaggggtaagctgagatgtttatatgtcaactcatgatgatcttcagctgagggctgcttctgggagatggtcattctaggcttttctggggcctcccaatgcaggggttggaggtaccaaggctgtgagaggccaaagctggcagttgaaagttagcccaaccgtgcaaaaagggatagagtcataacacttacagtgtccgcttcaccctctaagctcccctgtgcattcatagcatcccaaaagcatttattaagcacttccagtttgtaccaagtttagaagaagatccaaagaagactcagttatgtctgaacctaatggtcagatgggcgcacagcaaagccatcgccgtgcaacctcacagcaaaggcaagccaacatcagagcgcagaagagggagtagggaagtggagaaagcttccataaaaagagaaacctttgctcctgatggcttttaatatcacctatatgttaataactctcaaatttatatttcagcctgaactgcttccctgaatttcagacttgtagacctgactgcctacttccttctgcttgtatgtttcatgcagatctgtatttgttatcttgctggctaacaaatgaccccaaaacttagcagcttaaaacgactggcatttatgatctcacagggtttctgagggtcaagaatccaaaagaggctcagcagggtggttctggtctggagtctctcatgagactgcagttgagatgttgaccagggctgcagtcatctgaaggctggactggggctggaggatctgcttccaagatgatgtattcatgtggctgctggctggagacttcaggttcttcccacacaccctctccatagggctgctcatcatatcacagctggcttcccccagagcaaataacccaagaaagaaagggagacagagaatgagacaggcagggggtacagtcttttacaacctaatctaaatactggcataacatcacttctgtcacattttattggtcacactgaccaactctggtacagtgtgggaggggactacacacaggtgtgaataccaagaggtggggcctggccagttgtagtggctcacacctgtaatcccaacactttgggaagccaaggtggtcagatcactcgagcccaggagtttgagacaaggctgggcaacatggtgagactgcatctctacagaaaaatatttttttaaatgtatctggatatggtggtgcatgcctatagtcccagctactcaggaggctaaggaggaggatcacttaagcccagcaggttaaggttgcagtgagccatgatcacaccactgcaccccagcctgagtgatggagtgagactctatctcaaaaaaaaaaaaaagaaaatggttatggtcactggggtcatattgaaggctggtgaccacaggatcttaaacttaacatgcccgaaatggaactcccaaagtttctgccttcgtgcacaaagccatctgcactgtcttcctcatctcagtgagaatggcaaatccatctttccagctgctcaggccaaacacttggagacatccttaactccttcccttccatccacttacatctaatccttcagcaaatcctggtagctgtccctttaaaatatattggaattctgaccactttccaccaccctcattgctgccatcctgatttaaggcacctgccttatcatctctcacctggatgattgcaatggcctccccagcagtctccctgcttccatctttgagccccctgcagtcatagtgatcctgttaaaatgcattactcctctgcttgaaaccctctcatgagggcagaaaatcctcacagggcccttcaccgtctgaccccaccaccaccatcctaatctcacatcctatgactgccctgcaccctccatccggcccccctggatattgctagcatactcctgcctctgaccctttgcacttgctcttccctctgtctagaaagctgttcccaccactatgcccggctaattttttgtatttttagtagagacggggtttaaccgtgttagccaggatagtctcaatctcttgaccttgtgatccacccgcctcggcctcccaaagtgctgggattacaggcgtgagccaccgcgcccgccctgtagtcccagctactcaggaggctgaggcaggagaatggcgtgaacccgggaggcggagtttgcagtgagccgagatcacaccactgcactccagcctgggcgacagagcaagactccgtctcaaaaaaaaaaaaaaaaaaaaacaaagaaagaaaaaagaaaagaaaagaaagctgttcctccaggcatccacttggctggctcctcattgccttcaagtctttatgcagtgccccctgcttggaaggccttccccgaccaccctatttataaacttcctattcccttctttgcctttgttcttcttcttagcatgtttcaccacctccaaaccatctattttatttgtttttcttacttgtctgtctcccccacagatcgtaagctccatgaagatccctgtctgttttttcactactctattcatagcatctagaattgtggctgactcattcaggatgctaaaaaatatttgttgaatcaccagaaggagggaacatgaagaaaagtatttcagttatctaccacttcatacccatccaccttaactaggatgcctaaaacaacaacaatcatgtatttggctcctgaatatgcaatttgggcagagtctgggaagacagctgatctctgctcacatgacataggctggggaagctcaaaggcaggggtgacccaacagtgggggctggagtcatctcaaagccatcactgctctctggtggttgttactggctgtcacctctgacctcagctgggttcatcagccagaaccctaccctggcctcttcatgtgctgttggcttcctcacaatacggtgagttctaagagcactgccccgagaggcaagtagggcaagcttcccatttctgaaggccttgtcccagaaacaaatgcagtgtcattgccaccattttctaccgatgaagtggtcacagagcctggattccaggggaagagacatagactccaccttccaatggagaagcaacaaagaattgtagggccatgtttttaagaccaccacataaaggaagagaaagaaaacctttcccaggccccccgacttgtgccgagctcagcgtaggatgtttgcaatcatcaatacacaggtaagggcttgcccgcatgctgtatcatagaaagcggcacgcatctggtgtgcttctgtcctggcccatgaacccagcgctcactatgaactcaaacgtctttgctgtaagtcacactgcctttcagagatcatctagctttcttgttgtaagattccaggaggataacacactattccccagagaaggtattcagtatcaggccagggtgtgctgagacattcccagagggataagttacagactaacccaaatgactttttttgaaggcagtgccatatctccagcccaaagaaaaagctagatcaggatttctttttttttttcatcttttttttttttttagacagtctcactctgtcacccaggctggagtgcagtggcacgatctcggctcactgcaacctccacctcccgggttcaagcaatcctcccacctcagcctcctgagtagctgggattacaggcacccaccaccacgcccagctaacttttgtatttttagtagagacggggtttcaccatattggtcaggctggtctcaaactcctgccctcaggtgatctacccatctcagccccccagagtgctgggattacaggcatgagccaccacgcccagcagatcaggatttcttaactggggttctgtcgacattctgggtcaaatcattctgtttgggggctgtcctgtgtgcgttataggatgcttagtggcacccccagcctccactctctagatgccagtagcaagtcccccaacccttctgcagctatgacaaccaaaatgtctccagacatcagcaaccttcaccttgggggcaaaataacccccagatgaaaactgctgggttagagtgatgcttaaagtattatttgcagtattttctcagttctggatctgtttgaagtcttctcccctggctcagttagagctcctgaaccctttcatcttctagacaccgtgaaccatgtacttgaccatgtggcccatttcactgtgattattggaaaacttagaatcaaagatgtttcagggtgtatcccacagggacatgcatctttagtcttatgtctgctccattttacatcatttcttctttgaccaaactcttcatttatgcaagtcttcttatattttatgcattctttttatctgtcctaaatcttttctagaagaagggagagtacaaagagctaaataaataactgcagtcagggtaaatattcatggagatgacgtcagagagaggcagacacctgcctggagggaaataggacaaacagagcatgaaggcttgtcgagaaggcaaaaccagacaggtgggagccagacgatgtgtctgggcagagtgtgggtcacccagaggggtcactctccagaggggaagattagagagaagatggacagaggctagggtgtcgaaacccctcccccaggaaaggatcttgttttgttgtattttctgtttacaggaaagtcaggggaagggaagggatggtttgttcacttgttatttttgtttcagagacagagtcttgctctgtctcccaggctggagtgcaatggcacaatcatggcttcctgtagcttcaacatcccagactcaagcaatcctcccacctcagcctcccaagcacagctgggactacaggcatttgcatttgccatcgcatctggcatttttttttctttttttgtagaggcagggtctcgctatcctcagcctcccaaagtgctgggattacaggtgtttgccaccatgccgggccgggaaggtgttttaatcaatagcgtttaccaacaacaagaccccacctgccacgtgaatgagtcaccttggaaatgaatcttccagccccagtccagcttcctaaagtgatgctgcgtggagcagaaatgggctgtccccaccacgcctacccaaactgcagattcttgagcaaaataaatgcttattgtttttagacacaaagttttaaattggcttgttgcacagcaatagataactggaacatctttaaataactgtcaatcaacccctcccagactccgtttccttatctgaattgtgagccttcaagggtccatggagtgcctggcatggggaagggcctcctctgccagcaggtgtttgatatgactgcaaaggcaggcaggtactaagccaaaacacagccgtgcctccagtacggctggaggacaacacagatgtgaaactgaaagacggtggaataagcgtgcattcacttagaaatgagggctggagctcctaccgtgtgcccagggaaggagtagaaggaagtacagaactgtgggaagcagacggcggggaaatcccacactgctcagtcctggcccatttcctccctctcttctctctccctagggttctcatctctgccagccacatcttaatttttgtgtatgtcccaagatagtctttcctatgagtcccccacctgtatatccaacatcacctcctgggtgcatcaaagaccctcaccctcaataagtccagatccaaccttgtgcccacccccacctcccaacatcaagttgactttgttctgctctgcccaggtcagacagtagcttgtccacggccacaagtcatcagctagccaccctgcctcctcctcctcgcccccctccccatatcctaaatgtcactgagtcctgatggttttgcttcctaaataccattcaaactggtccactgctttccatcccacagccgtcccccaccaccatctcctgcatagccattgcaatggcctccttaatagcctcccccacccccatcgcctctcccctctcacctgccctcacagcaacagcaagctttgtaaaataccaaatcatctctctgcttaaaactttccactgatttcctggtgcacttaggttaaaggcccatgtcctgtcactatctacagtgggtcctgcaaggcccagcccctgtgaaacccacccactccacctcctctgtaaccacctcccactccctgcactgctgtctgtgtttcagccacacgggcttctttcagctcgccaaactctctgtgctccctcctgccacagggcctttgcacatgctgttgttacctcagccgaagatgcattcgacttacccccttccaacatacatctttttttttttttgagacagggtcttgctctgttgcccaggctgcagtgcggtggcacaatcttggttcactgcaacctcaacctcctgagctcaagcaatcctgcctcccaagtagctaggcctacaagctcacaccaccacatccagctaaccaacacatacttttttttttttttttgagatggagtcttgctctgtcactcaggctggagttcagtggcacaatcttggctcactgcaacctccgcctcccaggttcaagcaattctcgtgtctcagcctccagagtagctgagattacaggtgcctcccacaatgcccagctaatttttgcatttttagtagagatggggtttcaccatgttgaccaggctggtttcaaactcctgacctcaagtgatccacccgccttggcctccaacacttttaagaagcctttcctgctctctctgaccagaccaaccccactggtaccaaatggtaacgctctttcctggcactaatctccatttaattttacattcctttgtgtgattctttgatgaatgtcttcctttcatgctaaatttaagctcttgaagattatgactgttttttggtactgttataacccaaaaagctagttcagtgccctggcccgtagtaagcactcaataaatatgtgtaggctgaggaccatggctcacgcctataatcccagcactttgggaggctgaggcaggaggatcacttgagtccaggggttagaggccagcctgggcaacatagcaagaccctgtctctaccagaaaaattgttttaattaactgggtgtggtggtgcatgcctgtagtcccagctactcaggaggctaaggcaggaggattgcttgagcccaggagttcgaggctgcagtgagctatgattgtgctactgtactccagcctgagcaacaaggtgagacactgtctcaaaataaataaatacataaatatttttaaaaaaaagtaaaaattaaatgttttggaaagggcaaaaataattgtggggcagatgctgagaggcgagatggttagtactcgctagaaaacctgggcagcattttatgaggtgggtgggacttgaggtgaccttaaaggaggggtagatttttgtgttgatggaggcatttggaaggacattctgggtgggtggaacagaccagaataaaccaagaggtgagtataacgtgtgtgtgtgtgtgtgtgtgtgtgtgtgtgtgtgtgtgtgtgtgtgtgtgtgttttggatgacaggaggagatgggccagactagcagagatgcaggttgggaaaaggtgggacatcaggtcagccagcaagggtagatgatcaagggtcttgaaggcaggtggaggagtcggcatgtgaaaggcatgggagatttcagagcagagtggtgatcccaggcaggcattcagcagggcagcgagtagcaaagcctcgcggcagagcgggtgggacacaggagtgtggatggctggaggcagagaggaggctggtcagcatccaggcatgcaccaccgaggaccaggagggagggcagagaggacagagagggcaaggtggataaggaggcattaaggaaagagccatcccccaactgggtggctgttgtctgcagaggaccacacaggaaggtccccctccacactggaatgtcaagagctggtctgtcagacagaaggcaaaagacaccagtgccatttccccagctctgacactgcatggctccatgctctgctctgtgcccccttccagccgagtggatcaataccagccatcagggctgagccaagagacggaggacaaggttagctgtctgtagggaacgcatggaacacccagagcagggctgcctgggtgacttattgcttattaataatataaatatgtaaatgttacgagggccatattgatcccaacatatgagccatccatcatgagagtgcagaacagggtgttataaatatcaaataataagtctgcagcccaagacttatcaatataggtggtctaaggctgggacagtccccaaggcaattttataatgagagcaactccagcaacctcccgccaccacccccgccacagtgtgtgtggtttgtgagggggagggagagacagaggacccctcaaatggaaaggagatattcatatgcagggattctagaaagagagcctccccttttctcctttaccatggcaggaaaagccgtcatctgagctccccaaatctccaccccggggtagagagggtttctcatccccatgtatgctgaggcaacatagcctaaggtttagcacgtgggtgtggagtcagggagacctgggcatggaatcctgccctgcccactgtttgccagcttcgtcaacttcacaagtttaactgcttgaagcattggttttactcatctgtaaaatgggaatgttgacagcaatcggcaaggttgtgaacattaaatgggtcaacgtctataaccaccagtgtccatggtaggtatgactactatgcagagtggccaggggctcctggtgccatgagacctattagcctgttctcacagtgctatgaagaaatacccaagactgggtaatttataaagaaaagaggtttaattgactaacagttctgcatggctggggaggcctcaggaaacttgcaatcatggcagaaggcacctcttcacagggtggctggaaagagaacaagtgccagcaggggaaatgccagacgcttataaaaccatcagatctcgtgagaactcgctcactctcacgagaacaacatgtgggaaactgccagcatgatccaattacctctgcctggtcccacccttgacgcataaggattattacaattcaaggtgagatttgagtgaggacacagagccaaaccatatcagaggcatgacgctgaacagctccaatccagagtgtcccatcactacctccagaagatgtgcccagtaaagtgacatcacacttgaggaaggagcagcctaaccctagccatacccctcaagccccagtttggttttcctggtggatttcagtttgaatgcccacacagctcgtgaaggcacaggacatggggctcggaaatcagccggtccttacgcggtctctgccttcgggaatttcaagctacagtgggggaagggaccagaacacctaaaacctgaggctgagcaagtgctgttggaggggtgctgagtgctccaggggcttaaagagcaaggtcatgtccagctgaggggagtcgagaggggcttcctggaaatgagccgagagtcggcagcaaaaggagggagtggatccaagctcacccaccagcctgggccccgtgcagagcaggagctggacgggatgttcctgttcttagcaaacgcggagggagcccagacctacggctatgagcctgtgcccaagcctgggagatatttcattcatcataattttttttgcgttaatgttggcttttgattatttttatattgcattaaaatattatttatcttgattactgcatttttggtgtccccttaaactttgtgtccagcatgatgcctcaccccaccctcagctctgcaagtgactgcattttctgggattattccccctgcttaccagctctcggcttccagttatccaacccactttcagctggctccaactcgaccttcctagtcttctagactctgactccatctccccactgcccaccccagcccccatggtctcacgacccacctcagtgacgatcagcctttgcatctggtggcggaggcagtgcaaggaggagagctcctgccatcaatgccttctccctagggagtacccgcatcagccccaagctgcatgctttctggcactatctggttgcccctcacccagctcctgagaggtgggcaccgtcagcctcctttgtcaggtggggaacctgaggcccagagagactgtgggactcgccagattcacacagctggttgagcagtagtggacctgggatgcggttctagcaaaatgctcttttcaccagaacccaacatttcccaaagtgtcatccttggaacccatattccaggggctgtgtatttgtgagacctgaaaggactgccttcacggttggagaagcgtgacccgcagatgtgcgtggagggccatcatgaggaagacatcaaagatcctcggcagttctacagttccaaaaaaaaattgattttaactcagcattttgcaaactcattgacctcaaaactcttctttcatggaacatctccctgggtcagttgtccatcttatatagtcaagaaatactgacctgtttttagcgtgagagttttccagccagattctgctgatgggtcctgccaggacccatacctgcgctttgaccttgtaggtgaggggaggtttcttttctcacccctagattcatggctgagacacctgtaactaaaggcagcttaataagagaagagcatgcaaatgtatttaatgtaagtgttatgtggcacaggagccttcggaaatgaagacccaaagaaacaaacccatgtattcctgtgcttaggtttgtcaaagagcggacagtcgcgcagaagtgaatgggacacataaggtctgatgttaacatcataaactaggggggctcagcaaggcccatttgttcagactcttctgtgtccctgggtcttcaggtctaaggatgctccttttctctggacacaggaagagcacctctcacattagggtcctatgacctgcttcagaggaagggcagagaattcctttatggcctgtttccggggagaagggcaggagaaggccagagagaccttcccgcttctgctgctcctcaagtgccaggtgccatattttagggtagcggctcctaaaccccatcgacctctatgctgtactccattttccgacttagcttgccttggtgtaagaggaaggaagaggagagaggggctttaggagaagcccaggaaggatgttcagattttacattaactatttctatattgtttgattgtctcacacagcacatgaattactttgtgaggagggagggaaagagggggagaaagaggacaggggaagaaggggagtgttgggccgacccctatcaactccaatggaaatggcaacaaattcaagaggctgaagaaaggacccagagccagcaaatgggacatggggttttactgggagcttatacagaggggagagagatcagtggcagcaggctggggagaagaaccgcaactgtttgcaaaaggcatgcagtttctatagcagtttcacttagcaccctctcggctcagatgttcctcatagataaggaatgaatctctgggttggccactccggattccttagctcagaactccaaaccgcattcaggtgtgtctgccatacagggtcattctcaggatgtgcttaagatattgctatcaggtgcattgactaaacgggggggaaggagagaggaaaaaagaaaacaggagaggaaagaagggagggagggaagagagaaggaggaaagaaaaggaacacaagaagagaaggaggaggaagggagagaagagaaagatacagagagaagagagaagtggggagagtcaacgtgatcctggggtttgcagctcctacagcccatcctcaagtgagagaaaatctcaggcatgagagaaggctcagcaggcacaggcgtccccctcccaagtacccccttcatcttcctcagtcagttcccacctccaccccctcccaaccaaacatcaccaatcacacatgaattaaaagccatttccaggcaagcccagtggctcacgcctgtaatcccagcactttgggaggctaagactagtgaatcacttgagggcaggagttcaagaccaacctggccaacatggcaaaaccccatctctacaaaaaaatagctgggcatggtagtgcatgccagtagtcccagctactcgggaggctggggcatgagaatcatttgagcctgggaggcagaggtcgcagtgagccgagatcgtgccactgcactccagcctgggtgacagagcgagactctgcctcagaaaaaagaaaaaaaaaagaacaaaaaacatttccatgacagaggctttgcatctgtcatgagccctgggcctcagccacacaggatttcccagtttgcaatctttttgttcaactcccctctctccccagccattctaggtagggtggagggggcaggtcagggtcttctccctgccccccaggccagggcgccattagtattcagcatcttctcggtaatggtccctcttcatgctggtttgattttattattatgccaacacacttgcttaattctctgctgtctttcttctgcactgttgatttacactgttagtgttttaattatacaattcagcactccttaaaacatgaaaaactgctcaacttttcaagcaattaaaaggcagcaaagtatatcagcagatccgagacgagataagtaaatcaagcaattaaaaatgtcgtttggtgaaaatgtagcaacccacccaaaacgagcgatgccggtgggccctcccgaccagaacttcgaagagcggcgcctcctccatctcaccttcctacccgggaacgtggtgcgttctgcctcactctccctcttactctccctgtgttgaacgtgatgcctcgctgacctcagcccagcctggctgagagggcctgcgtgggatgacctcaggacttgggcgaccacagactcaggttttaacctggtcgccgagcagctcatgaacttggccgcatttctcctctctctcggcctgtttcccatcagcaaatgggactgcaccactacgtttttgtgtgggggtgagtaaaatataataacaaaacttaccatcgtaagggagaaaaaaatatcttttcctcaccatcctaggttcacggccgaagccccagtaacaagacagattaacaagaggaaagcatagaaagcatacacatttatttaatgttttacatgacacaggagacttcataaggaaatgaagatccgaaaaaacaaataagcctatgtattttttatgctaggtttgctaaagaagtgaacagttgtggagaagtatgttcagatgaaaaagtatgatctaggccgggcacggtggctcacacctgtaatcctagcactttgggaggccaagatgggcagatttcctgagttcaggagttcaagactagcctggccaacatggcaaaaccccatttctactaaaaatacaaaaattagctgggtatggtggcacatgcctgcaatcccagctactcgggaggctgaggcatgagaattgcctgaacccgggaggtggaggttgcagtgagccgagattgcaccactgtactccagcctgggtgacagcgagactctgtctccaaaaatatatatgatctaacggtcatacactgggggcacttagcaaagcctgcttgttcagattcttctctgcatccctgggtcttcggagataaggacgttcctttcctctgggtataagggagggttcatctcacatgagggtctaatgacccacttcaagccaaggtcttgggaaggtgagagagaccttcccgcttctgctgtttcctcaaatgccaaggtgcgtatctgggtatagcatgtcctgaatgccattatcatctttgccatttttaagtgtacagcgcggcggtattacattcatatggttcattcacatttgtatggtacagtcatactgttgcctaattgtcatcaccatccatctccagaacccttttcatcttgcagaactgagactttacacccattgaacactccccattccccttctcctgtacccctggtttctaagctggtttccatggagccccggggtttaatctcaggcccctagagggctgctaagagcaggagcaggtagcagggagatgagtaagcaaagctccattttaatctgtttaagctgttaggcctctggatttgattgcatttgagtataaggctctgaagattattttttgaagtcagaaaatgactggatgagaccatctgaaagacctggattgggaaggactggctgagaggcttgagttttttctaaagaaaagttctgcccacgagcaaggaggatgggtcctgcttctctgggtctagagcaggacaaaatacactccccccaaataagctgagctcaccccaggaatccaggctcctcccaggccttaaccagttccctccctcacgaactcttggcatcgtgacttcaggccccaggggacccagagaaccagggacgctccgttgcactgaaagtgagggtggggagggtggggacaggttgggagcagggacaggaggtgtgcagcccactcatccatcacacaaagagctggaaaggccagtggtgccacccagtgcccactcgctggccaggctgtctgggaggaggatattgactcaggcaagaagggaggcaaggtggcaggtgctgtggggtgggcactgaagaagatggaggggctgagagacagcctcaacccgcagcatctggctcagggcagaacctcccagaatagacacacttccccatccttcatcagccgctgtcaggaggattataaatgtgaagaggtggtgtccagaatcttaaccatgttggtcccagcaggaagaggcaaggccagtgcccctgagctcttggctctgggacccgggttcaggtttcctacaagagaacaagcacaccctggagtgtgcctggatccagccctcccagagactctcccctgggttggcttgagtgttcaagagcagacatgtgactggaaccagggtgggctgtggcccagcaggtgacccaggaagatctggctcagtgtgtggacagggttggagctgggggggatggaagagatcataaagacaggacctgtctatgtccctgtcccccacctcatttggatcggtttgtgacccatgactacttcccgctgtcatcggtggctgggagactctgtctgctgaacaagacccagtggagagagacaccaccagcaaatagccacacttgaaaggacaccgtttccagattctgattgcctggtcccttgggtgttgttaaagggaaggtaccaggttgaaaaggaaatggcagagaagccctctgcttccttgataaggtatcccgtatctcttcccctgaatggggagattatcagattgggtaacttactatttaaaataaaaaggatatattttaaatatcacacctaggttaaaagtgaaagtatgaaaaaagatatatcatgcaaacaataaacatcagaacggtgatgtctctatattactatgagataaagcaaacttcaaggtgaagaatattaccagagatagaacagaacattccataatgataaaaggataagtctattaaaaagacatagcagccccaaaatatgtgtatctactaacagaatttcaaaatatatggaaggaaactaacaaaactatacaaagaaattgacaaatttgcaatcataattggaaatcttaacacttctctcttaatacttgataggacaactagaaaaaaaatcaaaggacatagaagatgtgaatagcactatcaatcaacttggccgaatcgatgttgatagaacattctatccaacaattgcaaagcacacattcttttcaaattatcactgaatattcaccaagatagactatattctgcaacattagtcttgataaacttgaaacattaaaatattacagcatacttctccatagaaggaaaataagaaaacatgttgaattgaatcataaggaaaatatatgaaaatctatgaggaaaaactctgtttccactcatggagacataactgctgcaagaattgccctcttattgtaatcaaccagagaactggagaaaatataaaaaacagctgttttcagatactggactatggacagaacataacagtgatcccttaaataaaagaacaaacaaggtaagccccagcttacagctaagaggatttccaagcctcagcaaagcaaggaggaactcaaacagagcaaagggtctggctaagataagaaaagaaatgttggagtttgtggaggctgagggaccgaaattgggggcataacactgggcagaaaggagacacaaagagagagagcgtgcagaagatgtccaaaagagtcactgcaaatctttagctaagcattgatctgcctctgtggggagtaaaattccacgaggcaggggaaggaaccacttgaaagcagtggattcaaccattcctaaagttcacacaggtctgggaatgtttaccaagcttgttttcccacaaaccagagtggcaggacttcataacacacaggatttcatagagtcctcagaaaggtattgatttagtagtggggataaattagctctaggctaagtgatgttctgaaaaagcctgaacaaagactaaaagcaagcctcaaagggatcaaactgatccaagttaatttaattgtatgccagaatgaaatccaaaacattttaaagaaagaaataaaatccagcacaaattcacaatgttcaacatttaatcaaaaataacaagtcatgaaaagatgtggaaaaatataacccatgacgaagagaaaacagagcaagaaattacagaaataatggcattaagacataaaagcatttaaaaatgatgacaaatactttaataggctagagtggcagtccccagcctttttggcactagagactggttttgtggaagacgatttttccacggacagtgtgggggatgatttcaggatgattcaactgcattacatttattgtacattttatttctattatattacattgtaatatataatgaaataattatacaattcatcatgatgtagaatcagtgggatccctgagcttgttttcctgcaactagatggtcccatctgggggtgatgggagacagtgatagatcatcaggcattagattctcacagggagcgtgcaacctagatccctcacatgcacagttcacaatagggttgatgctcctatgagaacctaatgctgccattgataggaagtggagttcaggtggtaatgtgagcaatggtaagcagctgtaaatacagatgaagcttcacttgctggaccactgcttacctcctactgtgcagccccattcctaacaggccacagaccagtaccagtctgtggctcaagggttggggacccctgggctagacactatgaaagaaaacaagaacatgatgaatagagaaatgaaatatatgtaaaatccccaaaatatctttcagacacaccaaaaatgcaatatccaaaagaaaaagtaaaaatgcatttgaggggactaacagcagattagatactacagaagatcactgatcttgaaagtggagcaatacgtcctatctaaaattgagcacagatagaaaaagaatagaaaaaaaagagaacaaccagaaaataagtgacctgcagaacagtattaatgttctaacctatgtgtaattgaaactccaaaaaatatatatatttgcagatataataattggccaggtgtcatggctcatgcctgtaatcccaacactttgggaggttgaggtgggtggatcacttgaggtcaggagttcaagaccagcctggccaacatggtgaaactctgtctctactaaaaatataaaaaattatctgagcacggtggtgcatgtctgtaatcccagttactcaggaggctgagataggagaattgcttgaacccaggaggcctctgtgagctgagattgcaccactgcactccagcctgggtgacagagagagactccatctaaaaaaaaaaagagagagagagagaataatcaaattgtttacaaattggatgaaaatgataaacccacagatccagaagctcagtaaaccccaaacagaataaacattaaaacacacacacacaccaaggggaaaagacacattttgaagaggattaaagataagaatgacagcagactcttcaacaattgtgcaaaccagaagacagtggaatgacatctttaaagaagggaaagaaaataactgtcaaactagtaatctttagttagtgaaaatatatttcaaaagtaaaagtaaaaaaaaaagactttttcagacatacaaaagctgagagaactcctcaccagcagttctgaactttaagaaatgtaataggaagatattcaggcagaaggaaagggatatcagatggaaatctgaatctatacaaaggaagaatgtcagaaatggttaatatgtggatatctataatatccatttttcaatctcttcaaaagataactagctgcttaaatccacataatagttctacttctggccaagatggagtaacagaaaatggatttactctaaaatgctaaatggtacgactgctttggaaagttaagaggttggccgggcacggtggctcacgcctgtaatcccagcactttgggaggccaaggtgggcggatcacctgaggtcaggagttcgagactagcctgaccagcatggtgaaaccccatctctactaaaaacacaaaattagccaggtatggtggtacatgcctgtaatcccacctattcgggaggctgaggcaggagaattgctttaacccaggaggcagaggttgcagtgagccaagattgtgccattgcactacagcctgggcaacaagagcaaaaaactccatctcaaaaaaaaaaaaaaaaaaaaaaaaaaaggtcaaacacatgctcacaatatgacccagtgattctaatatctttttctaccagatataaaagcatatgtccacacaaagacttgtacatgaatgtccgtaagagctttatttataatagcctcaaattagaaacaacccaaatacccatcaacaagagaatggataaaccatttgtggtgcaaaatgggattctacacagcaataaaatgaacaaactactgatacatacaataacatgggtaaattcaaaagcattattcgtagtgaaagaggccagacacagaagactacaagctgcataatttatttatgtgaaattctagaaaaggcaaaactgtagtgacagaaaacaaaccagtggttggcatagcagttggagtggattgactaaaacagccacaagggaattttctggggcgatgagaatattctatactttggatgttgtggtggacccatgagtaacaacgttagtcaaaacccagtgaatcatagactgaaaatgggtgaattttgttgtatacaacttgtatttcaataaagtcattttttaaaaactgtgggatgtcaccaaagcagtgattgttgaaagatttgtacctttaaatgcccttattagaaaagaagaaagctttaaaaatcgaatatctaggtttctactttcggaagctagaaaaagaagagaaaattgaaaccaagtaagcaaaagaaagtaaataagagagaggctgggcatggtggctcatgcctgtaatcccagcactttgagagtctgaggtggatggatcacctgaggtcaagagtttgcctgaccaacatggtgaaacccagtctctactaaaaatgtaaaattagtcggacatggtggtgcatgcctgtaatcccaactactcaggaggctgaggcacgagaatcgctttgcatgagaattggaggttgcagtgagccattgcattccagcctggaaaacagagcaagactctatctcaaaaaaaaaaaaaaaaagaaaagaaaagaaactagataagagcagtagtaaatgaaatagaaaacagacaaaccatgaagaaatttaacaaagctcaaaatattcttcctttaaaagattgatataattaataaattttttaacaaatgaaaataagagaaagcataatttaccagtgagtgaaagaagggacaaatcctacaaaaatgcagaggacaataaaacaatattataaacaacattatgccaaaatacttatcaacttctgtgaaaagaacaagttctttggaaaacacaaattaccaaagcggactgaaggaaaaaaatagaaaatgaggatagctatataactatttaagtaattaaaatcctaattaaaaaaaaaatcttccagcaaagaaaatgctaggcccagatagcttcactggtaatggtattaaacacttaaaaaagaaataatacataaaacttacaaaaacctttttcagaaaatagagggtaagggaatactcccaattcattttatggtactctgtaccaaaaccctggaaaatgatattacagactaataccccttatgagcatagctttaaaaaaaaaactcttaagaaaattagcaaatcaaatccagcaatatataaaatgtatagcacatttcatgcatatgaatgtataaactcaaccaagtagagtttatctcaggaatgcaaggttggctcaacactgcaatttccaaggaatgtaattcagtatattaatgaattaaaggagaataagcacaagatctcaaaggattcaggaaaagcaaactaagaattgaaggataaattattcaagcaaataaagggcatatacaacaaagctatagttaatatcatacttaatggtgaaagactgaatgcttttctcctaagattgggaaaaatgcaaagatttctgcctttatcacttctacttaaaattaaactggagttctaaccacagcaataaaataaggaaaagaaattaaaagtatacttattgggagagaagtgaactctctttttcacatatgacatgattggttacattaaaaaaaactaatctactaaagaaaaagatctactagagctaaaacgttaatttaatgaaactgaaggacaaaggccaaaattaatttttatatataatcagcaaacaattagaaaataaaatagcaataaatcctattaacaatggcatccagaaatgtaaaatacttagtaataaatctagcaaaacatttgcaagacctctacattgataattacaaatgcaactgaaaaaaatctaaaaagacctaaataaatgaaacaacatatcatgttcatagattggaaggctctgtattttaagatgtaattcctcctcagattgatctgtagattcaacatccctatcacaatcccagcaggcattttgtagaaaataatgtgattctaaaatttatctgttggcttttaatgagtcttaactcagactaaaatgtaaagtctctatgtcagcatggtgtatgctctattggcccttcttcccctcccattttttgtatttaaatcaagttatggtttaaatgaggaacaatcaatatatctaattctttcctcttctctgcataaaataaacttgtgaactagagttcaggagcccttcactaggagggtggaaagcctcattaactgcaccaatgaggaagaagatgactgcatggactgataggaaacctcacagaagccgctgggcaagccctgggcagagctgcttttaaggcacattcttcccttgctggtgctgagaataaacagggaatggtgctgcatacggtttttttcaaaataaaaggaaatctatatgaagtacaaaggacttagaatagccaaaacaattttgaaaaagggaggaaattggaggactcatactacctggttttaagccttgctataaagctacaagacaatatgttattggtgtaaggatagacaaataaatcaatgcagtagaatagtgagtccagaaatagactcacacatgtcaattgattttttagaggcaccaaggcaatttaaggaaaaaatatctgcaacagtgctagaatgactgggtattcatatagaaaaaaataaaatttgaactccaaccttataccacaaataaaattagtttgagaagaatcacaggccttaacataaaagataaaactgttaatatggtttgtctgtgtcctcacccaaatctcatcttgaattgtagttcccataatcctcatgtactgtgggagggacccagtgggagaaaattgaatcatggaggcagttacctacatgctgttttcgtgataatgagtgaattctcacaagatctgatggtttataaggggttttccccacttcgctctgcacttctccttgctgctggcatgtgaagaagaacatgtttgcttccccttctgtcgtgattgtaagtttcctgaggcctccccagccctgcataactgtgagtcaattaaacctctttcctttataaattatccagtctcgggtatgtccttatagcagtgtgagaaccaactgatacaactataaagctaaaatcaaaaggactaacaagtgttgacaagaatgtggaccaaatggaactccatccactgctggtggagagtgaagtggtgcaaccactttggaaaactattaaacttttacctatcctatggctcagcaactgcacttccagatattgtcttagtccattcgagtggctctaacaaaataccataaactgggtagcttataaacagaaatttatttctcacaattctggaggcttgggagtcccagatcaaggcactggcagattgtatcactggcttcttggccacagacagcaccttgttgctgtcttctcacatgggtctctcttgggcctcttattaggggataggtatcatgagggcaccctaatgatctagtcatgccccaaaggctctacctcctaatactaggaggtactgctaacactaggccctaactcctaataccttaggaattaggatttcaacatgtgaatttggaggggatgcaaacatttaaaccacagctgtatttactcaagagaaaggaaaacaaatgtccgtaagaaatacctgcacaagaaaattcacagcaacatcatttacaaaagccacaaaccagaaacaatccaaatatctatcaacagaagaagagatagtatattagtacatattaatatacagagaaaatatatatagtaacatgtactaattatacatatatgtgtattatatgtatgtatgtatgtatgtactttttttttttttttagatggagtcttgctctgtcacccaggctggagtgcaatagcacaatctcagctcactgcaacctccacctcccagattcaaatgattcttccaactcagcctcccgagtagatgggactacaggcacccgccatcatgcccagctaatttttgtatttttgtagagacagggtttcaccacgttagccaggctggtcttgaactcctgacctcaggtgatctgcccgcctcggcctcccaaagtgctgggattacaggtgtgagccactgtgccccggcctgtactttattaattatatgtgtactgatacaatggaatactacttaggaattaaaagtatcaaactagtgataggtacaaacttgcatgaatgagtctcacagatactgtgttgaacaaaagaagaaagacacaaaatagtacttgctgtactgttccctttatatgaggttcaagagcaggcaagcctcatcaacagtaatagaaatcagagctgtgattgcctctggaaagagtgggattgacgggaaaaaagcacagggaatttttatactttgactggagagaggttcggttgcatgggtatttccattgtcagaactcatcaaattgtacacttaagatctgtgcatttcctttttttgttaattttacctttaaaaatgctacaaaagcacaagtttaaaaagaactgggctgggtgccatggctgacaactgtaatcccagcattttgggaggccaaggcgggcagatcgcttgagcccaggagttggagaccagaatgggcaacatgatgaaaccccatctctacaaaaaaatatgaaaattagccaggcatgatggtaacatgtgtctgtagttccagctactcaggaggctgaggtgggagaatcacctaagccagggaagcagaggctgcagtgagccaagattgcaccattgcactccagccccggtgacagagtgagaccctgtcagcaaaaaaaaaaaaaaaaaaaaaaaaaagcagaacacgacacaatgggaaacctaatgggttttgcctggtttgcctgccctataagatctggccctacctagacaggaccctatctggcagagctcactcctttactcaccttgctcttgccttgccagcttttcttttagttccacaagcacatcaagctcatacccctgggaacctttgcatttgtgttcccccgcgcccaccaccccctgccgccatttccagagttctttcccagatccttgcaggactgtgttcctaagagaggctccatggatcaggtttcctgcagaaaagggatggcaggcgaaacagggaaaatggaggtgagttcagaaagagaccatttccaaagccgaggccagagtgtagggagcccactagatagaatacagtgcctggtgctcatgcccctgggcctgaaaggggtaggggaggagaacgggaagccctttccagaaagtgttgatctgtccggatgagagccaggaaataaaacccagcttcactctccttcctccctcctgtccctgtcagtgctccccatgggcaaactgaatcagaactcagagggcaagggagccctcggctataggtcagcccctggacacggagtggagaaggatggagaagaaatttaggggatcaaacataatattcaatgcagacactgcccctggcttcccacctacacagcgattcggtcccgttcccttcttaatttcttcatggtacttaccgccacctgaactcatcttactttcttatttggtggcttgctgcttaccaaacgcccctcctctagaatataaaccccaggaatctggggactgtcctatctattaacgtatccctagtgcctagaacagtgccttgtacttaaaacagatgcacagtctgccataaatcctttgagaaaatgagcagatgggtacattactgcctcccaagcaggctgccagacacaagctagcacattctctccagactttttttttttttttttttttgtaattaacacactttttttttacagcagttttaagtttgtaaaaaaaaaaaaagatgggaaagtacaaatttccccaatcccctttctccctgcccccaccatttcccctgctatttataccttgtattagtatggaacacttgttatagttgatggaccgatattgacacactatgattcactaatggccatattttacattagggtttgctctatgttacgctggtttgacaaatgtagaatgacatgtgtccatcattgcgataacatacagaacagttccactcccctaaaaaaaactctgtgctccacctatccatctctgtgccctccccatgagccactggcaagcactgatcttttaactgtcttcattgttttgtcttgtccagaacggcatatagtgagaatcacacagtatctccatcattttgacccctgtggcactacagatcttccacaaacatttaccaaatacacaaatgaatggatgaaaggactcagagatgcccacattctgtagggtttggagcatcccatggagcagtgagcccaggccccttcccctatttggggtcgagaccttcattgcattccctcgtttgccctccccttccccagcctcactcgacgtcttcatcccttttaaattatacaaagatttccgtgtatgaaagctaatttagacaccataacagagactgtatttaatgtaaatggaagaagcggaggcagaaggatttatggaaataataaccggcctgtaataacacggagtgggtcacctgcttaagaaacagtggattaaggagaaggaaatttacctcccaaaagaacgaatgtcactggaaaactgccgcagtgccaagtcttggatgatcttattaaatcccatagatcttattatgtttcctaccaggagagactacttctttccctggttcataagaagggccaaagtgaggtctaaagtagaaaaggggaaggggagggcaaggggcaattcccagaaaggcctggagtcagcgcctaccgggtcgagggccctgtgtgcacatagcccagcactggccacacgctctgggcatggcatagagccctgagggtgggcaggggattcctgatgcaggaggatggggagtagataaggatccaggaagcaggaagctgcccatgcatgacagatggctctgacatcacagatcccaccctgtgcaggcgtgggtaacagggaggtccctagccatgtttcagacagctggggtgcaacagatgccatgcccgagatggtggttggaagtagcaggaggctttggatacatgggcaagctcctcatttagggaaacctgggttcaaatcccagccccactcctcactgtctgtgtgatcttgagtaaatcgtaaaattggcgtcacctattcccagcactgagtcaattctcactctgtccattcttcttgggaaattagccccaggaccaggatggccctgcccaggaggaaagaagcctcctggctgctagccagattcagacctggatgccttccggtaagagtaggagccgtataaccaccccccaaccttatcaagaacccttgttcccaggagaaacatcagctcccccaggccttgctgtcatccccagcatggagcccagtggggacacacaaccctgctggctgtgagtttaacctctgcagctggtgccccatcctgagcctctccctgctcctgccctccccacctcctttctgcataaaggtttgttaggaagtggctaagctagagagggccattggggaccacagacagagatcgcacgctacaggattatggctgttccatagtgcactgcagctatttgaatacatttgcatgaactcacaagtctcaatgcacttattgtgggatgtcctcatattggttggggggaggtggggggaaatggaggggagggagaccttgccagggaatgaaggcaaagccacctgggccaggaagagggggtggcttccaaaaatcccaagaagccattctggaacttcttagaggactgtctccatctgggacctcaaaccaaggtggacaggacacaggctcatctccctgcagggaacctgttcctgagttcctctcgcaggagtcctgaatgaggagggcttgggcgctgagaaacaggaagcatcatttgcctggtgcaagtcaaagatgggccacccacagggcttgcatagggaaccatggctcacctcctccaaagctgtgctccaatcccacctccacagcgagtcattccctgaccacattattaattctgcaaccgactccccatcctgacccttccccatcatcctattccttttactctctgctctacttttttttttcaatatcactgtggacttctaacgtaccacatggcttcctaagttattatgatcattgttaggttgagctccacactagaatgtaagccccatgagggcagcaatggttgtccgttgggttcgctgatacatcccaaatgactagatctgtttctggaacacagcagatgctctataagtacttcttgagtgaaagcatagatcaaccccttaagaaaagaagtagccaggcgccgtggctcatgcctgtaatcccagcactctaggaggccaaggcaggaggatctcttgagcctaggagtttgagaccagctgggcaacaaagtgagactccatctccacaaaaaataaacaaaatttgccaggcatggtggtgctcatctgtagtccaagctactcagggcctgagatgggaggatcgattgagcctgggaggttgaggctgcagtgagccatgattgcaccactgcactccagcctgagtgacagagccagaccctgtatcagaaaacaaaaaagaaagacagaaagaaagaaagaaggaaagaaaggaaggaaggaaggaaggaaggaaggaaggaaggaaggaaggagaaaaggaagaaaggaaggaaagaagtgggctgttgtcccacctcatttattcccattccgcatgctgttccccggcctccctgggaatctctgtccaggtgtacagtaacccaaacctaagccatatccccagcctaaacagcacgaggaaaaccttctgaaagttgatgggaacacttaagacaaacccagcattttgctcagagggcagctgtggggctgccccacactcagaggcccactcagggcccctgcacttctgggataaaatgggcaaagggatggccctgctgggagcaaagcagcccggccacatctccctggctgcgctcagctgacaaggtcctcagcttcccctcctgcggggttcttcatcatcccagaaatgtttgcatttgcaggttgcaattaacattagccttggaagatctctgttttgtgggagcctcttaatgaagccattgttcttggcacctgctccacccccacctcatcccagcacccacacacactcacactgcgttctatttgggctctcgggaaatgatggaccgggagctactcagggattgaggtggcctccagggtctgggcagcttcttgagacccaaaaggtcttctaccctataatatgggccccatcacccagggggtgctacagagactatgggtctgagaacaaaggagaaattaggaatcagaaagagaaaatccactttccctcccccaggcaaggcccctgcctgggaaagccaggcagaagcaggggcgttgagggagatggagggctggccgggagtccgcacatgcagacgaggcgggagtgcctgagactgagaaatacagcagcctctcagagcagcaggcgttccaacagaatgacttcttttaatctaaatttgatgagaccagggtgcctttcacctaagagagagggaagggagtgtactccttgctccctggccttgagtcctccctccccccgccaccccacctcccctgcagaacctgtcttgccttctcaggccacttcctcctctttcatgccaccaggaatgccccggctgcggcacacacattcctcggtgaccagggtgtaattcttattgacctgatgtttttcttatcactgcccggccagagctccctgagttccccaagggagtgatcaaaaggactggtttgcccaagactgagtggattcccggaatgcgggtctttctgtgctgaaaccaggaaaatcctcgaaagccagggtggtggatcaccctattccaaagaaggtttcaaggggctcatgggagacccttccccgaacagctggacgccatcctgaaggccggaacacctattgtgacatgaggtctccacctgcccagggaggaagctgggtcttatgacttgtcactatacccctgtctgctccacttcaatgctagcagcactttcaaacaattaagcagacataaatcctgaaggctgggaggccgaggcgggtggatcacaaggtcaggagttcgacaccagcctggccaatatggtgaaaccctgtctctaataaaaatacaaaaaaaaaaaaaattggccgggtgtggtggcatgcacctgtagtcccagctactcaggaggctgaagcaggagaattgcttgaacccaggaggcggaggttgcagtgagctgagatggtgccactgcactccagcctgggtgacagaaggagactccatctcaaaaaaaaaaaaaaaaaaaaaacaaaaaaactcctgaagccaaggcatcctgacttttcttcttggtccctgcccctcaacatccatgcccagcccatcccatgcactccctatctctcatctgtgcccacctctgtccaccctgcagtgccactatcttgatcacctgggctgggtgaaacagggctaactgattgggacagcccagcccagcccagttgccaatgtaccaggaatacactcagtgttatgggttgaattatgtccccaaaaaagatacgttgggctcctaaaccccagtacctatgaatgtgaccttatttggaaatagggtctctgcagacacaatcaagtgaagatggggtggttaggttgggccctaatctaatatgaccagtgtccttagccaaagaggaaaatgtggacacaaagagaagacagccgtatgacaatggaggcagagattggaacgatacgttatacatgcatccttacggagccagggaatgccgcagataacaagaaaagaccagaagctaggaaagggcaacggagcaccctgcactgtaggtttcggaggaagcataaccctgccgacacctgaatttcagactctagcccgcagagctgtgagaccaggcatttctgtgcttgaggccacccagttgcagatcttgattccagcagcaacgagaaactcatgcaccaggccaacatagcggatcagaccgagaaaccacaagaaaagtggaaaccaaaagagggagtgggagcgaagtggatcaccctggctccggggctgcctagggtccccgctggagctggggaaaatgatggagctccagccatcaagccacatggccaggactttagccgttcccatgctcaaccaggccagagtgctgccttgctccatctgtagccctgccttgtgcaacgtcaaagtggccaggccatgggccacctcctgaccccactgagcccagctccagggactcaagtcagtgccaagtcttctctgcctcctcccactcccactccaaatggaagagacaggtaaggtcaggctgcaggcatttcattccctgctgagtccccgggagaataccaaccaggactcagaactagcctggcacctggaaaccatagccccactttatttctgtgttcctcctggagaccccctgaaataagtgtctgagcctgccaggttctccccaaggcagagcctgagatgaggacatttgtagtaggggtgtcctatctgggaggccaccccagggagcagtaatgaaagaacaagagggtgacatagggacagaagaaagccagcacaggagtgctgttgagaccactactgtgagcagcaggaactccttcctccgggacctctgaagaatgaatggcacagaatgctgcccagaactgtgccctgtaggactaggggcgggggcaataacccactgcccccacattgcctggctgcagatgctcatagaccagacaagcaccttagaagctcccaccagcatcctccaggttggaggagccgggggcagagatgggaaatgtatgcccttgcttggggcaagatggcatcagtgtggtcacagtgggagcctgcagggcaccgtctcctggctggcctggatcagaggtggggcggagcagatgcaggtcaggcagcagactgcctgctcagtagataaatctttctgcagacctttgaggaatgactcatcacttatacccaggtggggaatttgtcttccccttgcaggtctaggttaagaaaaacagagagagggtggcacatgattgagagcttttgatgttaagtttccctgtgttaccagcccaagaaaccctccggtgacgggcaggcctgctcggggacagagcacagtgtaatcagggatcgtgtctgcttcagaagtggcctggagcagagatcccagcagccagggtggctggcaggagagaagcaagccagacatccctgctcccctctgcctgcctgtctttctaagtccaaaagccagcacaggctatccccaccctgaaaataggctgggatccaaaaagtgttttgaaacatctgctgtttggaactggaaagcaccttctcattgaaataagactgtgcacagctcctcaggccccagcccaactcacaggaaacccactgagcgtggcccaccaaaacaccatgcaatcaacggggtgagcacgtcatagagtccccttggaaagcacaatcacggtcacaactcagggagctagaagcacagagttccctaggcagcaaggtcaggggatcctcctcttcccatcctctcaactactgggcagtggcatggggcagtttccaagctccaaacttctgatggcaatcttatagccagagcgaggactccagcaaacaggaccgggatgaagctggaggaacttgaggggcttctgaagctcagattcatctccaggagctgaggaggcacaggggaaagcccaggagaaggtggcactgtaccctctttctggccgtatcttaggatgaagagggtagcctctgcccaaggattagatggaagtcactacaagtcaccagcgcctgtggctaaggctgactcccagcctcctggattctcccctgctgctcagaccacagctcctggaagctcctccctcaatgtctatgggctccactgggactcaatccccaatccccagctcacttctctgaggacccaacacagcctccatcttctggacaggccagctgaggcccagcatcacccgggaagcaagtgccagaatctagaccaggacacagaaccgctcacccccagccggcccacctactcaccaggaaggtgcaaggaaagctcctgtttctcgggtaatgaaggccgctcagcctctgcttggggatgggagcctggagcgtatcttttgggaaattacaggtatcactttatctttccaggggaaaaaataaccatggaaaacgcctgcaattacagctcatcaccactgactgtgtaactgcagcctaagtgcctggtaatcagaagaccgcagacaatgagaatttggctttatttagcacctttctactcctccacctccaaccctttagcatgatgtgacagcaggagcctggttttgcaaacactcgatacagcctttccacagtctttccatacaaagatcgggccactgacccttggctgtccacggaaatgtcaacttcttttctttccccagaggtctggctgagtgttactgggccacctggcccctctcagtcccttgctctcgtccgaatttagtcttttattcaaccacatttgtggagtgtcacctctgtagcagccatggagagaggagcaagtaacacagcagtgaacaagccaggcaaggccctgccctcctggggattacattccagtctgggaaacaaagagtacacagggaaacctgtaaatacaagaaccacagcacatcaccagaactatgaaaaaatcttaaaggggccgggtgcagtggctcacgcctgtaatcccagcactttgggagaccaaggcgggtggatcacctgaggtcaggagttcaagaccagcctggccaacatggtgaaaccccatctctacaaaaatacaaaaattagctgggcatgatggcgggtgcctgtagtcccagctactcaggaggcataggcgggagactcacttgaacccgggagatggaggttgcggtgagccgagattgtgacattgcactccagcctgggtgacagagcaagattctgtctcaaaaaaaagaaaaagagaaaaaaggaaaagaaaaaacttacaggtgatggggtggatagcaacacacagggacacattagggtggtcagtgaaggcgtctctgaagaggtgacatgcccactaaaacatgagggtgaggacaagtggttcgttacagtcaaaggtgagaaggcagcagatgcaaaggccatggggcaaaaacatcttactgggcctttagagctgtgtaaaagctaatgagtgcccagaacacagtgagaacagaggagaattgcataagctgagcttgaaaaggcagcagaagagatgccacatgacacaaaggagtttggatttgaagccgattggtaggttttaaccaaagggacgaaatcatatgatttgtatttggaaaatatcaattcggttgccaggtaaagaatggatgggcaggccaggcatggtggctcacgcctgtaatcccagcactttgggaggccaagacgggtggatcacttgaagtcaggagttcaagaccagcctggccaacatggtgaaaccctgtctctactaaaaaacacaaaaattagctgggtgtggtggtgcatgcttgtaatcccaactacttgggaggctgaggtgggaggatcacttgaacccgggaggtggaggttgcagtgagccgagatcgtgccactgcactccagcctgggcaacagagcgagactctgtctcaaaaaaaaaaagaatggatgggcaacagacaacatggagaacatgcgggctgggcgaccagcagaggctgctgcagggacctgggaggtgacaggaaatagcaagaaggatatttacctatttgcgtttgggagaagaggccacaagctggattagtgttaatggaggtgtgacgatgtggagaggatggagcagatgctcccggagtctgtccgagcagctgggtggacgggaaggccatctgccaaggaggacaaggttgctaaaggcatgtacaggacagaagtgctggtccacagcctgtttgctgccaaatccatcccttatgctgcccttgcccttctccgtgtctcagaggggtgctgacctcagcatttcccaggctcctgtgtcagctgggttcagccagtgggagacactggtaggggattgaagggcaagagtagcggagttgggacatctccctccctctctgcttcaagcagagtccaggaagcaggtgttatctcctctgaggctccagctcccaggaggcagctcccctggctgtggttcccgctgggtctccccagcccctggggtcaaggacccatctctgttccttgttcctccaaccacaagtagttaaacttcctgcctttgctaacctctgggtttctgcatcattccttgtttggtttctcagtttttccattacctgtgtaaccaaattccgtctgctttaaaaatttagagtggtgtatgtaattctgattggaccttgactggtacatgaaatgcctggatgaggtgggaggtgcaaagctggtccatgtggaccttaaaattttaatcttatattgatcctgcctcctagaattccaagtaccagcctccaacaagcagagttaaccacaactccctttggaacataaaaccacaaggtccagaggctgaaaaaaaccttaaagatgccctagccctaactgttacccaatgctggatgccctttgtaatgccttaccagattatcttaagcctgggctaatcaccttcagtgacggtgtattagttagctgttgcaattataatgctgtgtaacaaaccatcccaaaactcagtggcttaaagtaacaagtagtttattttcttgctcataggtctgcgtgtggctcagatgtttctccttcaagctgagggcttggtagagcttggttccaattgggttcaagtctgctctatgtgtctacacattctctggagaccagaatccacctaagcactcttctgacagaccacaagctctcaggaggatgagccaaaccacacgacatcggaggcctctgttcgcatcacatctaacagaattccactgcaagtcacacagccaagagcaatgccaatggggtagggagatataccccacaagatcacgtgacaaaaggaatgcatgaagactcaggaatgataatgcaaccagtaaaaggtttcctctgtcctgattttgagctggaatctgcctgtctgtgtgtgatggttaatataggttggcgcatcattaaaagtgatagcaacgaccccaattcctttcgcaccaatgtatattaggtgtcaacttgattggattgaaggacacctagataactggtaaagtattatttctgggtgtgtctgtacgggtgttgccagagaagattgacatttgagtcagtggactgggagaggaagacccatcctcagtgtgggtgggcaccgtccaattcagctgccagcgcagctaggtcacagcaggcagaaggaggtgggatcagcttgcttgctgaatcttccggctttcatctttctccggtgctggatgcttccttctgctccttctgcccttggaccccagaatccaacttcttccgcctttggactctgggacttacaccagtggcttgccagggactctcaggccttcggccacagactgaaggctgcactgtcggcttccctgcttttgtgcttttgaggcttttggactcggactgagccaataccagcttctttcttccccagcttgcagacagcctatcgtgggacttcaccttgtgatcatgcaagccaattcaccctagtaaactccctttcatatagacatagatcccattagttctgtacctctgggaaccctctaatacatgatgttaagccaagttttctgtatccctgttcttccacgtgatatactagacaacctcctgcgggtccgaagcccacttttaatcttctgcctcatgaacctccccgatttctttaaagtcctgattttcagacctgtcatcctgtttgctcccctctgaatatgatcccattttattttgattacacctcatgcataatgtccacaaccaactgcacttggtattttctaaccatgacagattccttgtccctgtggcaaggaatcactagtggaagctgagtccatataagcaagagaaggcagcttcccccaaagcactgcctccagaaggttctcttggttatgccacccacacagatgatctctcctcttacgctgaaccccacagttctcatgcatcgctaggcctgtgcttgttgacaagctgcttccggtccttagccttgggtccatggacggacatcatagctctatttgggcctcgagaacttagaagacagggtcttctttgggaccacagtacctggtaccagggtctgggagcccctaagtctatgtttgatgattggtcaagtggtcatgattgaggggctcaagtagctttgcccatagacactcaactattctttaaggggtcaagtctgagctcttcctaaagcagcctccaccagaatacaaagctgggtgtgagatctcagcactagccctagtaaatatctcaacccctctagactgtagagatgtttacaggagctgtctgcactgatttaggctggtcaactggagggagtcacacacacacacacacacacacacacacagctaagaactcaacaggattttgaaggcctaagcaaagctgacaactgatctacagcctccttccttcagctggaaggaatctcatatccagggagggaagaggcagctgtagctgagaaatagaatagggaatgcctcatcaggagaaggatggaatagcaggcactagaattaaagggggacttttccccataatgttagtggaacccttggccagacagcttctccagtgtattagtcaggatagaataggataagctgcagtaacaaatatccccaataccctagtcctttagcatagataagagtttgtctcttagactacatgggcatcacagatcagcaaggggctcagcttatcatgatctctcaggaagccaagctggcaagggcattatttcaacatttgctccccctgcccccagtgctccccctgcccacagcagtgggaaggatgtgtcacagaccaggcacccgttctgaaagttgctgcccagaagtgaaacatgtgtgttcatattttcttgattagagtgagtagcatagtgattgccaactttaaaagaggtaggcaagtgcaatccttcacatgcacagagggcaaagagcacaaaagaccaccatgcctaatgtcaaggtgggagcctcagcccaggggcaggacctccacagggcagaggtgcccagggcccagctcctccctggtgggcctcttgtttgctctctcttgctcactccttctccctccccctcttgctgtctttttccacgtattcattcatttaacaaatattgattgcgccttcatacagcagaatgtggggcagcccagtggacacagcagattcagccctgatcttgtgagctcttgtccatcaggggacaccagcaaccaagcaaatcccacgtccaccgcttctcaagccaaaccccacgtcttccttgatccctctcttcctcactgcccacatctaattcatgagtaagtcccatcaactccactccaaaatcatgctgaatctgacacccccctccaccacagatgacccctgtcccatcacctctctcctgtaccccagtagaggcccctggatggtctccccatcccactcttcccacctggagtctgttctccacacagcagtgaaagcaatcttaaaaaagccaatgggtcgggcgcggtggctcacgcctgtaatcccagcactttgggaggctgaggcgggtggatcacgaggtcaggagatggagaccatcctggttaacatggtgaaactccgtctctaccaaaaacaaaaaattagccgggcgtgatggtgggcgcctgtggtcccagctactcaggaggctgaggcaggagaatggcgtgaacccgggaggcagagcttgcagtgagccaagattgcacctctgcactccagcctgggcaacagagcaagactctgtctcaaaaaaaaaaaaaaaaaaaaaaaaatcaatgccaccaggtgcagtggctcatgcctgtaatcccaacactgtaagaggctgaggcaggataatcacttgagcccaggagttcgagaccagcctgggcaacatggcaaaatctcgtatctacaaaaacaaaaaatgcaaaaatcagcctggcatatagtggtgcgtcccagctatttgggggactgaggcaggtggatcacttgagcctggggggatcaaggctgcagtgagacaagatggcaagccgatatgagtggaaggcaaatataaaataggtgaacaaacataaactaaacacaaattgtgttaggcattatgtggacgacaagtgaggaggtgctgagctagtgaaactcacagggacagcctggaggcaggcagtcagggaaggtgtttccagcacctgccatgccaccctggcctcacctcctaccccatcatctgctgcagctcccagtcctgcacagaccagcctcccataggtgccatagggcagtgcctggcctcagcctacacggtgactctgaggccctctgtcacggtggaaggaaacatctgagggctctcgctcttgtgcaatcctggagagtgggcgacttcacgtccttggaggcaccccgaccaatggaccgacggggacaggagcccatgcacagaggcttttccctttcatcctggggggcaggcctgaggtgcacattatacaaccccatggggcaaagcgccagtgcctgtggctgcagctgcctccaatattgctttttcctccttccctgcttcactcccttcttccttgctcccacttccaagaatcatattcccaaataaacaacatgccagtaagccctcatctcaggggaatcaaggctgaggcagaggcctccttgagcaagtgacggctggactgagctgcacaggccgagaggagaggaaggaagaccaccccaggcagcgaggatgagtgggagcagatatccaaggggtcccaggggctcatgtgtctggggaataaagaaggggcagccggagtggcctgagggtagggagggagaaggcatcagccctcgaaggaccttctgaacaaggccagagagctgggacttcctccaagggcagccggaagccatcaaagggttgaatcaagggaattcacacagctcaatatgcctttgaaaacggcggctgcttgtgttcgttccatctagtctctgcgtgtcttacatcctcccctttttctttcataacctggctcttctccgcctttcattctctctgactcccgtgcctacctgaccctctcccgctccttgcacccgctaacctctggggctgcttcctggacctctctagccctcaagtcccgttaaagacaccatgaagagtgaggcaataaggcgaggcagcatcgtagtggggaccgtattttctgagcccatccaggactgaggtctgagaaatcttgttgcacccgcgggagggttggggcaatgtttgaaattggagctgtcgtgagagttctgagaagtacggttgccgtgactgcatggtgaatccaaattgcaggagtcagacaaagtagaaatcgctgtccccaggatatgggggaagaattcagggatgggcagtgggaggcattgagctttgtagcccacacacctggcttctctccaacaaccaccaccactcgctgaatggccacgggcaagttacttaacttctccaaaactcaactccaatgtttagaaaaatggggcaataatacagaattcattaggactctcggtcacaagtaatgggaaacacacacaaactaccttaaaatgaggaggggaacttgctctcatagagcaccaggagtcttccagagacaacaagacaggcgcacgtttctcctcctctctttgtctctccagccagcaccttctacttcccagccagggtagagaaagccagaaaactaaaagaaagcctgggttacagcccgggcaacacagtgagacctcatgtctacaaaaaataaaaataaaaaaatcagccaagcgtggtggtgcgcacctgtagtcccagctacttgggaggctgagaggggtggaatgcttgaaccttggagtttcaggctgtagtgagccgtgattgcaccaatgcactccagagggagaccctatttaaaaaacaaaaaaaaaaaagcctgggtttatatgttaagatttggcttcctggccaggcacagtggctcacacttataatcccagcactttgggaggccgaggcaggcagatcacctgaggtcaggagttcgagaccagcctggccaacatggcaagaccctgtctctaccaaaaatacaaaaaattagccaggcatggtggcacatgcctgtagtcccagctactcaggaagctgaggcacaagaattgcttgaacctgggaggcggaggttgcagtgagccaggacggcgccactgtactccagcctaggcaacagagcaagactgtctcaaaaacaaacaagccaagcacggtggctcatgcctgtaatcccagcactttgggaggccgagtcaggtggatcacctgacgtctagcatttgagaccagcctggccaacatggtgaaaccccatctctactaaaaatacaaaaattggccatgtgtggtggtacgcaccatggaatgtgcctgtagtctcagctcctcgggaggctgagacaggagaatcacttgaacctgggaggcagaggttgcagtgagctgacaccatgccattgcactccacaggcaacaaaagtgaaactctgtctcaaataaacaaaacaaagcaaaacaaaacaacaacaacaacaaaaaagacaaaaacaaaaaaagatttggctttttttttttacagacatcagtctctgtgtgtgtgtgtgtgcgtgtgtgtttgtatgtacgtgtgtctgtctactgtcccaattccaaatttctagtagtagctggcccagtggatcaagtgacacgtgtgggccaatcagccgtgctaaggcaccataatctagagagagaagtctgagtgacttagattagcctggaccaagcacctgcagtcatggtgaggctgtgatgtgccaattcaagtgtcagaaccccaccctggaacatgtgtgtgtgagagtgcgtgtgtgtgagtgtgagtgagggtgagtgcatgtgtgagtgcatttgtgtgtgagtgtgtatgtgagtgtgtgtatgagtgtgtgtgtgagtgcgtgtgtttgtgtgtgaatgtgtgtgtgagtgtgtgtgtgcgcgtgcgcacgtgttgggtgaaggagagacatccttcccagaaaagcaagggaggctgtagctgggcagttgacaaacagggaacaccacaaaaacctagtccctgaaacgggatcatgttggtgaagtgctcacagcaacagctgcaataaatggttcccgcgactgtaagctgacccctgcagtgctatttatctcctcctccagcaaaacttccttagagctgcccagggccacagtcttcacttccttatctctcgttccctgcttactgctccacgtggagtaaaaccacatctctgtggtcacactcatccaagttcccaagttcccatcctcctaatgatcaccaaagtcagaggtaagttttctgttcctcttctgtgttatttctcaacagtgttcaggatgattgcccactctgtccttcctgaagtgcgtccttctcttggtcattgggctcctgcctcctcccagttttcctccgcctccactggcctatgtttctgcgtgctggcgtgccccgacactcagcccttggcccacctgcttctctagccagtaactctccaagggcctcatccacttccgtaactttgtcatctacggccaatgaccttcacatctccattccagccctaacttctccccagatctccaaatgcctctatccaactgcctgcatatcatgctatcttcacatgggtgttgtaaactcagcagagtgaattgaaccccctctaccctgacttccccatgccattgaaatagcattcagtgacataggagttgtcccagactcctctctttccctaacccgctacccccaatccatcagcaagtcctgcaggctctgctcatcagtcataggctgaattcatccacttctctccagccatctccactactatcaggcagccatcacttcttgcctgcactaccccaataatctcctaactggtttcctccctttctctgctgtcccccacaatccattctccgtttaaacgccaaagcgatgatttcaaatgtataagccagattatgtcatgtccttacttaaatgcctttctttaacactcagaacagcacgctaactccttaccttaaccgacaaagccctagaggatctgccactgcccatcccccaggtgctactgcacgccatccccccacaacacacacacactctgctccaggcacgctggacagcttctgtttctccaataattcaagcttattcctgcctttgcaaccacccactctgcctagacagcttttccccctccacaccttccaccaaaccctaaagtcccatcttcatgtgaccagctcctctgatctcccagctcttgactgaaaagtcacccctccagtgggccttccctaattgctctatctaaagaaactgctcagggctgggcctggcggctcacgcctataatcccaacactttggaaggccaaggcaggaggattgcttgagcccaggagtttaaaaccagctagccaacacaatgagaccccatcacttaaaaaaaaaaaaaaaaggtttttgtttcaataatctggatgtggtggcaaacgcctgtgtacctccagcaatttgggagaagtgagaggattgcttgagtcctggaggttgaggttgcagtgagcggtaacttcaccactccactccagcctgggcgacagagcaagaccctgtcttaacaaaaagaaaagaaaaggaagctgcttagtggatctgtatccgtcacctattgatttctctgcatagaaatcagtacttttcagtcaggcgtggtggctcatgcctgtaatcccagcactttgggaggccgaggcaggcagatcacgaggtcaggagatcgagaccatcctggctaacatggtgaaaccccgtctctactgaaaatacaaaaattagctgggtgtggtggtgcgtgcctgtaatcccagctactcaggaggctgtggcaggagaatcatttgaacccaggaggcggaggttgcagtgagccaagatcacgccactgcagtccagcctgggcaacaaaaggagacactgtctcaaaaaaaaaaaaaaagaaaagaaaagaaagaaagaaatcggtatttttcaaatttatttattggtttatgcatctgtccttttctaatgtatttatttctttatggtctatcattcaccaaaatataatctccgtgagagtaaggacctcatttattcttctgtcccctatgtccaaaacagtgcctttcacatagttagcacttaacaaaatagaagaaaataataaatatatagtaaaggggcaaaaggggtaataaaccaaacattatttaaaaaaaaaaaaaggtcacttgtggatgaagaagtgcaacaaatatctggaaagggaaaaatgatggaagtgtgcagatggaggaagctgccactggaatatgctcccgggaggctgggttgagtcagccactgaatttgcataaagaacgctagagagattggggcttgcagttgtcaaatacaacctgtggtgggagggaaaagggggaggtggtgccaaaaacacaggggttaattgaaactctgtggaacaaatttgtcattcaccaccctccaaccccactcccacctaacagagcaataggcaacacagcgaaaaccagaaagcactcctggctaaatcaatgaaactgctagtagagaatgggaggccggcgcggtggctcacgcctataatcccagccctttgagaggccaagacgggaggatcacttgagctcaggagtccaagaccagcctcagtaacaaagggagaccccctctataccaaaatttttttttaaattagctgagcatggtgatgtgtgcctgtagtaccagctactcaggaggctgaggctggaggatgacttgagcgcaagagttcaagcctgcaatgagctgtgattgttctactgcactccagcctgggcagcagagcgaaaccctgtctcaaaaaaagagagaaagagagaacagagcggctgttgtggctgctggtgttccatagtaaagttcatctcgttctgccatttttgcctccccacaacctagcttcacagccacgtccctggccagtcctcataaagcaaagccagatagtaaagcaagccctgcacatgaacccagaggtccgaggcagcatctccatataggggaggtactcaatgggaaaataaaaccacatataaaaatcaggaaacccacgccaacctcctagaataattacccccgtccttcattcttaaatagaaacagaaaaatgagattcactagacatgtgacaaatgaaagagaaactctaagattaaaaaagaaaatgaacagcaatccaaatgtatcatcaaagaaatgtggaagccgattacgtccaaaaaagagaacagattgcaatgaaaaaaggaattatcagagaacaagaaaaagttcttagaatttaaatcatatggttgttaccataaaggccacatatggcaagcccacagctaacatcgtacacaattgcagaaagttgaaagctctttcctctaagatctggaataagacaaggatgcccagtttcaccacttctattcaacagagtactaggagccctaaccagagcaattaggcaagaaaaagaaataaaatgcatcgaaatagaaagaaagaagtaaaattgtctctgcttgctgatggcatggtcttataaatagaaaatcctaaagactccatcaaaaaactgtcagaactgataaaggaagtcagtaaggttgcaggatacaaaatcgacttacaaaaatcaatagcatttctatacactgctaacaaactatctgcaaaagaaattaagaaaacaaccccatttttaatagcatcaaaaaaaacacaggagttaattgaaccatgctgaaaacaataaaacattagtgaaagaaattgaagataacacaaataaatggaaagatatcccatgttcatgggttgaattaatattgttaaaatgtctatactacccaaaggtatctcagattcaatgcaatccccatcaaagtttcaatgtcatttttcacagaaataaaaaaaaatcctaaaaatgtgttcagaaaaacaaagggggtaaatattatgttaagtgttcatactcccccgccccacacacacaaaaacaaataaataaagtcagtaagaggaaatttagagaagtgatggatatatctatgaccttgatagtaggaatagtttcactggtatatacttatccccaaaccaatccagttgtatacattaaatatgtacagcttttgtatgtcaatcataccccaataaagtggtttttaaaaaagaaacaatatagttgctgaaatataaatacattagaagggttagaacgtaaagttgagagaatttccaaaatgttataagaaagagaaaacctgcatatgcagaaagaaagaaaagataagagacatagcacatcaatccaggaggtccaacgtctgactaatagaccctatagaaagcgagcagagaaaaaaacatacataagtaaactactaaataaaagcagaagaaggttttccattatttaaggcagaaagaatctttcggaatataatattgggaaacattagttcatcaaacaaaaagaccctgaaagtctccagagagaggaaagaagttacttacaaaggaattagacaccacctgtggtttctcatcagcagtactggatccagaagtaaaatgaggccctcaacattcccaggaaaaatttgttttgaaattagaaaactatgcccacccaaacaaacaatgaaggaaaaaaaaagtctcagacatccaaaaatgcagaaaaactacctcctctgcatcacttccaaagaaattaccagaaaaagtactctaacaatataaacaagataccaagaaaaagagaaagttggattcaagaaaaagcagaactctcactaaaaaggaaatcccaggataatggctggttggaaccaaatgtcagtgtactctaaagacaagttcttcaaaaagagcacagtaaattccgaacgaggcaggcgcagtggctcatgcctgtactcccagcactttgggaggctgaggcaggcagattactcgaggccaggagttcgagaccagcctagccaacatggtgaaaccccatctctactaaaaatacaaaaattagccaggcatggtggcgcatgcctgtaatcccacctatttaggaagctgaggcacgagaattgcttgaacctgggaagtggaggttgcaagatagctgaggtcgcaccactgcactccagagactccgtctcaaaataaagaaaaagtaaataaacaaataaattctaaatgataggtagacttaataagaaattggaagatgtttgtgaaatgatgagtaagataattttgcttccaccaaaaagaagaaaaatatacacttaaggccgggtgcagtggctcacgcctgtaattccagcactttgggaggctgtggcaggtggatcacctgaggtcaggaattcaagaccagcctggccaacatggtgaaaccccgtctctactaaaaatacaaaaaattactcagcgtggtgtcacgtgcctgtaatcccagctactcgggaggctgaggcagaagactcgcttaaacctgggaggcagaggttgcgtgagccgagaacatgccactgcactccagcctgggcaagagagtgagactctgtctaaaaaaaaaaagtatatatctatatacacacatatatatatatacacacacacacacacatgcacacacttaaaaatgccaagaaaaaaattgtaccaaacaatcatgatctgaatcatgaagcaaattaaaatgtggcatgattttgaacaagtgatggagaatacaaaaagatttgattttgtataagggttatgatatgagattggagaggaaaaaaacataatccctttataccatactactggttcactgcagaaaacaatgcttatatcatcacaaaatacaaaggctgttgactggatttcaacttttaaaatcattgtatagataaaacatgaatgacataaatgtggttaaaaaacaaactttcaatgtcgccaattttgacaatgtgaaagataaggatgcagaagttgggaagttagaaggggtggggagaagaggagaaaggagaataggaaatctaatcatgtcctcgtgttacagggtgggcacacagaattactggcttacattaagggaataagaattggactttttaggctgggcatggtggctcacatctgtaatcccagcaccttggaacacctgaggtcaggagttcaagaccagcctgaccaatatggtgaaaccccatctttactaaaaatacaaaaatttgccaggcgtggtggcaggtggctgtaatcccagctactcaggaggctgagacaggagaattgcttgaacctaagaggtggaggttgcggtgagctgagatcatatcaccgcactccatcctgggtgacagatggagactccatctcaaaaaaaaaaaaacagaattggaagaatcggactttttttgagaccaggtttcactctgttgcccaggctggagtacagtggtatgatcatggttcactgcgaccttgacctcctgagcacaaatgatcctcctgcctcaacctcctgagtagctgggactacaggcacatgccaccacacacctggctaatttttttgctttttgtagagatggggtctttctatgttgcccaggctggtctcaactcctgggctcaaatgatcctcccacctcatcccttcaaattgctgagattacagatgtgagccaccaacaaaattggatattttaagtgtattaattaaaattgataaggtaaccagtagaagaaataattaccaaaataggacgtagatgggggaagtaagcaaagtcttcatatctcacagtagggaaccaatatgggcctaaagttaacaaatcaagaaatggaagtttaacaatattagaggtcaccaaagaccacacacacacacacacaacacacacacacacacatacacgacagtggttgcctctgaaggacagaactacacgtatagactcgtggggagttctttatgatcagctgactgaaaaaggaaattaaatcagatctaatttacagatggttctgcatggtatattggcatcaaccagaagaagactactattaatacattaccactgtaatcgagagcatctcttaaaggcagtggttaagggaaatcctcccactagacagaagttccagcattatctttggttgtctacttgggctgaatggagagataaccaaaagtatggatctacactaacttatgggctgtggttaatggctggacaggatgctcagggacttggaaataacaagattggaagatgaagacaaggagctctgggaaggaggaatgtggatggacttcttggagtaggcacagaggacaaatatgtttgtgtgccgtctgaatattcaccaaagtctagccactgtagaggaggttttcaacaagatgacacattttgtggatatccatttacatttttccccaggcccctgatggttgtgcaataggagagtatacaaaacagtcacagtggcaatagcagagtctatgtgtgggcttagtgataagaactccactcacaaaatccacctggctaccacctctgctgcatgcccaaactgacaacagcagagaccaacactgagctggtctctagtaccattctgcagggggattagccagacatgtggtaacaggttgattatatggaaaggggcagcaatttgccctccctagaataatatgtattcaggatatagatgtaccttccctgctgacaaagtttctgctagtactactatccatgacctcatagggtgccttatcctgtgaggataaggttatccaccatcatgatattccacagatgtggtttggctgtgtccccacccgaatctcatcttgaattcccatgtgttgtgggagagacctggtgggaggtaattggatcatgggggcggtctttcccatgctgttctcgtgatagtgaataagtctcacgagatctgatggttgtaaaaaggggagtttccccacacaagctctcttctcttgtctgccgccatgtgagacatgcctttcaccttccaccatgattgtgaggcatccccagccacacagaactgtaagtccattaagcctttttttcttccaagtctcaggtatgtctttatcagcaatgtgaaaacggactaatacacccacatgacaatgtttctgatcaagaaactcactttgtagaagtaaagtggggctgggtgaggaggctcatgcctgcaatcccagcactttgggagaccaaggcgggaagatctcttgagcccaggagtttgagaccagcctgggcaacatagtgagaccccacctctacaaaaaaaaaatacaaacaaaaattagccaggtttggtggcatgcacctgtagtcccagctacttgggaggctgaagtaggagggttgcttgagcccagagaggtcaaggttgccgtgagccatgatcgtgccactgcatcccagcctgggcaacagagcaagggccctatctcaaaaaaataaaaataaaaaagtaaagcaatggctcatgcccctggaaatcaatggtcttcccacataccccatcacacaaaagcagctggtctgacagaacaagcaaatgacctactgaaaactcagtctgccaactggacaataacattccaaaagattggtctgttttacaggatgcagcatatgctgtgaattgatgtccaatctacagccatgtttttcccagaccagaatacacaggccagggaaacaaggagtggaagtggaagtgactcctcttactatttttaaaaaatactttctgtagagaaggaatctcactatgttgcccaggctggtctcaaactcctggcctcaagcaatcctcccgtctcggcctctcaaagtgctgggattacaggcctaagccaccacactcagccacctctcactatcatacctaacaactctcacagaatgtttgtttcctatcccctctttaactttgaactctgctggtttggaggttttaggaaccaaaggaggaatgtttccaccagagacccagtgattgttccactgaactggacatcaaggctaacacctggacattttataggctctttatgctgctgaataaacaggcagagaagagaatcactttcctagttagcaaagagaaactagttagctactatataaaggagacaaggaacccaggaagttctctggtgacccgtgtagtacttccttgtctaagggaagactaatggatatggaacaggcaatgagagaaggaagttaatatcaacacgacctcataaaaacaagaacatagaaagcaggaatattttcttccttgcctgttgatatgtatacatgtttgcactggcacatattaactaatgtctcttctctctcctttgccgtttttattttatgtaaagattattagcagtggttaacttcacaatttcatctttaagttacaaaatattcagatgggaccatgactagttttgaggggtgatcaacatcatctagaaacgagtaccatgactgtcactcagaggaggatataagagctcttgggattttatgtctcctctctttgagaacactgtgagtgtctttgtacaaaagataattgcatgttataaggtaaaggtgtacgtttgttgttatcattagatggtgttcagtacatgtagatggatgctgagtagccaaaggggtggaggactgtgtcagctgtcaagctatcatctctcaactccgagctcacccttctatttatttatttattcattcatttatttttatttttatttttattttttttttgttttgttttgagatggagtcttgctctgtcacccaggctggagtgcagtggcgcagtctcagacactgcaacctctgcttcccaggttcaagtgattctcctgcctcagcctccagagtgcctggaaccacaggtgcctgccaccacacctggctaatttttgtatttttagtagaggtggggttttgccatgttggccaggctagtttcaaactcatgacctcaggtgatctgcctgcctcagcctcccaaaatgttgggattacgggcatgagtcaccacgcccagcccgagctcactcttctaaactctacgttttggtgctaagattggggctctgcacataacatctctccttcgtcaactggctccttgttgggttctgcctgtaggaggactagagagaaaccaaaggctggaggagagaaaagaggcatatgctctttctgctggcttattcttcttgtccctgtctctccagcaacagatctccccccgagcagcagcagtgcattccagtagccagtttttactgcacaatctcatcatgctccttcagagatagcagcaccagtcagccaggctgcagcgtctgaggtctaaacccagctccatggggcctcttcttcaagcttgtagagtcagataaccacgacatctcccttttgttctgcccatcctagggatgatggcttctttctctagttcctctaaccatgctacttcaatgttctctttgggctttttcagtcctccaatacctgtttagccaattctctatattaaattctctgttaagataactggtgtggtttctattttcctgactgaactctgactaatacaagcaggcaactgtaattttttattataagcctcctatacaattggaatttgtttaaattctgcatgtatactactttttgttacttttttccaattctgcaatgtaattgcaaggagagtgcagttacagagtactgccagaccatttagaagaagaaactcctcggccaggcgtggtggctcatacctgtaatcccagcactttgggaggccaaggcgggcagatcatgaggtcaggagatcgagaccatcctggctaacacagtgaaaccccatctctactaaaaaaataccaaaaaaaatcatctgggcgtggtggcgggcacctgtagtcccagctactcgggaggctgaagcagaagaatggcgtgaacacaggaggcggagcttgcagtgagccgagatcacgccactgcactccagcctgagcgatagagcgagactctgtctcagaaaaaaaaaaaaaagaagaagaagaagaagaagagcctcctctacactgggttggtcatggaagacttcctggaggaagtgacatctaaacaaaatttgaaaaactcattgaaattaaccaggcaaagagtgtgagatagtaagccaggcatagggaataaatagcaagtacaaagggaaggaggtaataaggcctcattaagttcaaggaagagtccggctggagcattgccagtgtcaagacgggaggctggggaggagagaggtgattggatcagaaaggacctctgcaaccttagagaggagttgggacattttcccagggactgtgaagatcttagagagtttcaacagggaagaggcatgactgtatggccggcagcagacacccaacatccttgtgcccaccttgagcacgctggcccttgctctcggccaagtcacatcatctccagcacttgcccaaactccacatctcccccgtcttcccaggcaggcgcctcctcagaacacatctgtactgagtttccccctcagaaaccttgttaggacactagttagtgtgataaactaattcacggtgaagtgttagcaaatgaaaatggtttatcgctcctcggggtattttcattttaaggagactccgttgacaaatatttactgaatggtctattacatgcaagaaactatgtaaaactcctagggggagtcacggcttgacctaaataaatcagtctctaatgatagaatcctaggctcaccgggaagcattgcaggcagcacacagcctttcttatctctgcttaaaccacattagcctctctcttgatctgccctccatcccgacccccactcctcccctccaatggggctgagcagaggccgtggcccccgatgtttaactgtgacttccctgagtggtgttgacattgctgggactgtattgggggctcaacagtcaatcttcgccccatgttttggaatccccaggtctgccccatgggaagccagaaggaactgtactgagggagctccatctcccgtccttggccacgctctgcccccacctccacccagacacacttacggagggcctcctgcacacctggccctgtgccaggaataagggccagggagcagggggcaaggatggggaacagcacagaagtcccacacctgcacttcatttcagcacgagatggattctcccttgaatagtggagcctcaggccgggcactgtggctcatgcctgtaatcccagcactttgggaggctgaggttggtggatcacctgaggtcaggagtttgagaccagcctggccaacatggtgaaaccctgtctctactaaaaatacaaaaaaaaaaaaattagctggatatggtggcgggcacctgtaatcccagctactcgggaggctgaagcaggagaatcacttgaacctggaggcagaggttgcagtgagccaagatcgtgtcatggcactccagcctgggcaataagcgatactctgtctaaaaaaaaaaaaaaaaaagtggagcctcctcacctggttgattctcctcctctctttctgtgtgtgtgtctctctctctgccttctgagataccaaactaaaacagaaaggaggatgagaggcaggaaggaaggatgaatgccggaatgggatgaacagtgcttttccagctgctggtcccccaagtcctctctctcaccccctctctcattgtcaggctccactcctcccaagctggattccccagaaccaccctcatcccctccggcccctccccacttacctgtttgcaacgcccttcttggacagcacaggtgagacatcccgaataaagacactgaacaaggaagtggaagccggaaccctggcgctttcgtcagattcactgcatagtgtctagagaagcttacctgtgccttagctaagttcccaggactcactattcccatctataagatgggcacagcccaggccctgttatccccctaggaccatctagaccttccctctccgccagcccttcccaggctcccccttccatccattaagaaacactggcatctagtggttgtgtgagggacctgcagcgcagacccggcttccaagaacagggcccatagatggagaagcctctgacagccctatctagaaacaaggagccccgtattccatactgccctctgcagcatccctccctctccctctgaagaacccccaagacccccaaacaacatgggagtcaagaaccagtgttgaaatggccatgttgcccatccttgctgaagaccacccagacacctccctggtgatgaggaggggagagaacctgtggatgaaacaccccatggccaatccacaaagtgagtcattaggagctgagcacaagcccaaattccagacaaataggacagcttcctaccacggtggctgccaatctgccagccactccatcatgtgacccccccccccagacacttagtcagcactcccaggtgcccagcatcataccaggctgttgacagtgtgtgcctgcatgtgtgtgtgcatggatgagcacagggagagatgtgtgcagaggaaagaagaggcacacagcatgagtcactggcagacataagcaagtgaaccataaaataatctaaattcatttattcaacacatacttcccaacacctgctgtgcaccagagagagctgctcccaagccaccaagggctcaccccaaccctaccacctgacagctacctgaaaatagtctaccccgcactcctaccctccagttaacctactttgcatacgttaaagactgttttaccattggcttgcatctctgcatcccctgtagctaggtctaccccgcactcctaccctccagttaacctactttgcatacgttaaagactgttttaccattggcttgcatctctgcatcccctgtagctagcacacagaaggggcctaatatgtgcttattgaagtcattaatccagtccagcgcctgccaaagcgggaatcccttctgataacgtcaccgatggctgctctcccagccccctcaagggccaccggttattccgtatgctgttgtgtccgtcaggtttctgtggcaagggacagaacagcaactcggattcactggagtagagaagggagctgcacaggcagagagagcagagttgggtgctggcaggtgcggattgagggtaagaaagagaacggagtcaggtgctggcaggcctggatgaccacatctggttttcccatccttttattctgttttccttagccccctgccatgcccatatccccatctccagactctgcttctgtttgttgctggtcctagcctgcccttctgcataccagctgccttcatgcagcaggaggaagggagatggccacaggctcttccaggcttgcacgatcctagcacaggatcccagaggctccctctccctctcctgttgaacatatcttttttttttttttttgagacagcgttttgatcctgttgctcaggctagagtgcaatggtgcaatctcagctcactgcatcctccacctcctgggtgcaagtgattctcctgcctcagcctcccaagtacccaggtagctgggattacaggcacctgccaccacgccaggctaattttatgcttttttagtggagatgggggtttgctatgttggccaggctggtcttgaactcccgacctcagaagatccacccgccttggcctcccaaagtactgggattacaggcgtgagccactgtgcccggacatatcttgaggaatatctaaatctcaggaatgactctgtctggaccagttccgatccctgagtccccactgcccaacctcctgtccattcttaaggcctgagagacaggtacaatgtcccagggcacacatgtctgcccctgtggtcaaggggaggggaaaggacactgttactacctgcccatcagaattgtgtgcaatgggaagtaggacagaagaatcttccaaatgagggagggtatcttaccaggaagagggaaggagacatgccgagaaagtgcagtgtttcaacagtgtcccccaaaacattcacttccatctgatcctcaggatgtgacctaatttggaaatagggtctttgcagatgtagttagggtgaggatcaagcagagattatcctcttgataatctctttgaagggtgttttggggggccagccgtggtggctgacgcctgtaataccaacactttgagaggctgaggtgggcagatacctgaggccaggagttcaagaccagccaggccaacatggccaaaccccatctctactaaaaatacaaaaattagccaggcgtggtggcacacgtggtggctgtaataccagctatttgggaggctgaagcaagagaatcgcttgaacctggaaggcagaggtggcagtgagccgagatcgcgccaccgcactccagcctgagcaacagagactctgtctcaaaaaaaaaaaaaaaagaagagattatcctggattagggtgggtcctaaatccagagagcatgtccttttaagagacaaaaaaggaaacacacagacacaggaaggagaccacgtgaggatggaggcagagactcgagtgatgtggccacaagccgagggacaccaggagccccgccagcaactgggataggcaagaagggaccctcccctagagcctcagagggagcacagcccttccgacacctggatttcagacttctgtgctgaagaactgggagagtatcaatttctgctgttttaggccaacaaatgtgtgatcatttgtgatggcagctcttagaaaagaacccaggaggccaagaccaaaagtcgtccactgtgccattttctggggtggcagatgttttagggggctggaaagcacctggtggaggtgtcagctcacttcccagagccacgcccaccagccgccactctgctgcagagactcggctcaggaccactcctccctgaactgtctgtctagagcctgcacacatgtgtgacatggcagaccctaaagtgtccagagattttaggacctccccaccaccaccaccatcaaccacttatgagtaaactgaggcccagagaagctaaacagcctgtccccttcagatagttagaagaatttctgaatacaaggaagaattcttcagtaaaattgatacatgacctctttctttcttctttgttaaaaaatctgattaattagtaaaagctggagtgtttgatagtcactgctgagaacactggaatcgtcaggaagctaaatgcttctgagcaacgggcaaagcgctggagatcaagcgggcatttttttggcctaagattttgacagggtcaagaggacgttcaacccctcactgagccttcgcgctccttgtctaatttaattgtttggaagtcagaaagtgcagtagctttctagtttcttcttttccaggctgagatttcattccttgaaacattcttctttccttgatacagtttgcaaggcctccaccttgctggcaagcaatctgtgcacacactcaccgctcctcactgcagcctcactgctgggctgcctgctctggccctgccgggagacctgggctggggcaggatggtggccgctgcccggaggcacggggcggggagagacgtgttgagatcaggcctctcccatcagcccccaggcccaggagtggacacaaaacatggagagcccagctcctgactcctcccattccagccctcccagccccctccacagagaaatccagagcccatcccaggcagcttctccaggcagcaggtggttccacagcctaattcaggacctctaatctccccccaggtccccagcttctgagactttgacgtactgactcctgcctcccacctgcgaagcccagcaaagctctcgcctttctcccactcccaagagttgacagactccaggctgcttttcagatgatttggggaccttcctgggagacactttgaagcctcttcaaagccaactgtgttgtgagcagctgccaagctgcagaaagtccccgcagccctgggccacctctaattaccaagcccaccatcaccctgtcagtgcctttggtgggcccttcctctgcagccagcagcaagtgcccatcgtcacccaagagcaggaggagggagaggagtctgcaaggaacttcttccaaagaacactgcacttccaaagaactgcacctgaggagttcccgtgaacaaacgtgaacaactggtctgatatttactaagcgccaggggtgcccctgtgctgtctcacactgagctaggcacacgaagaaaatggaagttgtgcaaaggctcaacttctgttctccccagtttctctcctctgcactttaggctctgagctgctgagctcccagcccaggctgtctccagctcctccagcctgagaaaggagcacagatcattgattctctcctgggctcctcacccacccctccccttgtctccacctcattcccctggatccttagttaagaagaggcaaatgttccttctccattagcagcatcatttaaacagatggctgcagggcagggcccgaagcctccccatccccaggccctgcagcttttccttctacctgcttcccactccccaccccaggctgggaagactggtgagaggctgctgggttggctgggggagaccgaggcagcaagtggccccagagctccgcaggcctacctgcccccttaagaaccaagccccctccccaccctgggcctgtagcttcagagcatggggctgaatctcatcaacaagaaatttgaagccattaaaatacaatgaaagagaaattaaatgtaatcgctctgtaaattataactaattgaaacatcaattgtaatttttatgatctgcattcagagtgagtgatggtggagttgcaaaatgaaagttaaataatggtggagatgtcccgaaatgccctctggcccccagcctctgcctccctcctcctgcaggcttccctcccttctcttccagaccctgcctgaaagctctgccttccggaagtttcctccatgtaactgcttctcatggcctcagaggcctcagtctgcccattagggggcctcctatattggaaggcctcttgtatagggcctcagcaggccctcctgtttccctgcaacccccaaaaagggctggaaggccttcctggttccgcacatttggatcacgacccccaggtcccacccaacatgcttggccaaactccaagctcggaaatggcagacagagtgcctggagcctccgattctcccagaacttaccctgttgcagccacatggccatggagtcatgagtctggaaggactacaggtcacctgatccattcccctgcctccctcccagctccagcaaggagctccagggccttgggtcagttgctcagcaccagcaccagcttccctcccctcgtcccatggccggcagtgatagggaaaattcgagtgacccttcccaggggtggggaccctgccatgtttgggccacccttcctcctccctgcttgccagctatccgctctgtgtgcggcacccatgagagcgtggcatccacgagagtgtggtgtgtgtgctgcagaggcaagcagacctgcattacgtctccaccatgagggcgctgccgcttggctcttctcagactccgtttcctgagcagtaactgagagacaataatgacattcctctgagagggctgggctgtttagcaacagcagcatttgtgaagctcttagcacagagcgggcacctattaaacctagggatgattattgtcatcgtttgtcattatgtagcccagctccaggctattttcattttgctcccagcagatccctgggacctggtcccttccccccgacccctgccaactccctctccagtacattggctgcccctgtgcagatcagaggcaggcagctgggtacaggtgctccccacaccttctcctggctgaagacttcttaggattttggcaggaaattaatgaatcttccacagggtaagaaaacaaacccctggtctccgctcctcctggcagagacagggcagctcctggcaccctggatcccagcaaactggtcgctgactgacggaggaggcctggtctctgcagtggccaactcccagctgaagtggacggggagacaaggtcaggaaggccagtccactcccacctcctcccagaaaaagtcttgaacaagctttattttgatggctcggtgtagtgactaatgcctgtaatctcatcactttgggaggccgaggcggatggatcacctgcagccaggagttggagaccagcctggccatcatggtaaaaccccatctctactaaaaatacaaaaattatccgggcatggtggtacatgcctgtagttccagctactccagaggccaaggcatgagaatcgcttgaacctgggaggcggagattgcagtgagccgagatcgcaccactgcgctccagcctgggcaacagagtgaaactccgtctcaacaacagcaacaaacaaagttttgttttgaggtacagatttctagaattatcacatccccccaatgcctgtttctcatgaactgacctctgcctagaaccgccccatcgcagaacataacagacactgatttccctagtgctggttccgttgggcgggagtcaggacctgagccctgggccgcctgactttctcacccagggagcctggtcgctcctccccttggctggcacacagcttctcaccggacagatgagctaattcagtgcatctccagctacccgaggtgcaggacctgtgggtttttttaattaccagtctgtgacagatcaacaccttaaaatatttttattaagatataattcacgtactgtaaagttcactcttttaagatgtgcaatcccgtggttttcaatgtatttcagaacgttgcacagccatcaccactacctaattctgcaacattttcatcagcccagaaagaaattcatacccttagtacttactcctcatttcctccttcacccagcccctggcaatcactaatctactttctgtttctgtggatttgcctgttctgtacatttcatataaatggaagcatgcaatatgtggcttctttcacttggcacaatgtttgcgaggttcatccatgtcattgcatggatcagaacttcattcctttttgtagttgaataatattccatcccataggctgggcgtggtggctcatgcctgtaatcccaacactttcggaggccgaggcaggtggatcacctgaggtcaggagttcaagaccagcctgaccaacatgatgaaaccccatctctctaaaaatacaaaaaattagctggatgtggtggtgcacgcctgtaatcccagctactcaggaggctgaggcaggagaattgcttgaacccaggaagcggaggttgcaaggttgcagtgagctgagatcgtgctactatactctaacctgggcaacaagagtgaaactctgtctcaaaaaaaaaatatatccatcctatagatataccacattgggtttttttctggcaggagtggggggtttgttttgttgttgctgttgttttgagatggagtttcactctgtcacccaggctggagtgcaatggtacaatctcagctcactgcaacctccacctcccagtttcaagcgattctcctgcctcagcctcctgagtagctgggattacaggtgtgtgccaccacacccggccaatttttgtatttttagtagagatggggtttcaccatattggccaggctggtcttgaactcctgacctcaaatgattcacctgccacggcctcccaaagtgctgggattacaggtgtgagccaccttgcccggcctagatataccacattttgtttatccgctcatcagttgatgtacatttgggctgtttccactttttggcaattgttagtgatgttgtaacaaacatttacgtgcaagttttggtgtgatcatacgttttcaattctcttgagtatacacctaggagtagaattccaggttgaacttttttaggaactgccaaagtggtgttaccattactgtgtttgcaaaaacaagataaatattaattattagaaaaaataaatttgaaataacatacaaaacgcaaggctaatttttattattaaatcaaaaggcataaaattagcttgtcaaattgctacgaccgtttctaaatgcttcctctcagtttctagacttgcttggtcaatgatgggtaacacacagttcttagactggcactagccctcggaccacactttgagtagcctggaccgtctgcatcctctccactgcctccagcataaagggcagccccttggtgtggggtgcaagccccatccaacactggcccctctggcctcatttcacaccagccacactgtgtgcccgttctgtacccaggactcccttcctggcccccttggactgattgttttgagatggagtttcaggcagatcacaaggtcaggagatcgagaccatcctggctaacatggtgaaaccctgtttctactaaaaatacaaaaaaattagccgggcatggtggtgggcgcctgtagtcccagctgctcaggaggctgaggcaggagaatggcatgaacccgggaggcggagcttgcagtgagccgagattacactactgcactccagcctgggtgacagagggagactccatttcaaacaaaataaaagtgatgagaagcaaaagctgtgtaaggctggtggctcccctggttcttgggttatgaagtggcagggtctctcttgagctgagatttgtagttcctggttaaatgccagggtttaatgggcgtgctagggaaaatgttttttagtgagtggtaaatgtctccctggtgcctgcggtggtaattacttcaatggcaccatctctctttaacatgctcctggccagggggaagggaggggctctgaacagagggaccaactctggaagctgtggccaagggcatctcttggaggaagccgagggagggaggaggaagagacagaggtgagcccacacctggcccaagccaggatgacagcggcccggggggccagggttcagggcagccaaggcagggatgtgtgtcatgtgtccgcgcttcaggtctgattattgggtcattattgggtctctacctggatgaggttacaaggaaaaaatttttaagtttttattgaattataaaacacatacctaaaatgcacgggtgatagtgtttatttagcaaggcaaattttcacaaggtgaaccttacagcaaagcagctcccagagcaagaaataaaacagaacagaacaacccccgcagaagcccaaaagtccttcccagccactccccacccccaaggtgaccattgtcctgacctttgtcatcatgtccgttttgcatgaaaactttgtaatgtcactggggatggtcaatgctaaggaaatcacatatatgggggactcagggggcacagaggagggacatgtcacacaacccacagcttggagaagactccaagaggaagtgatgtctgaaccaagtcctggaggatgaagagacgtgaaggcagaggtggagaaagggggggtgcgtgcgtgtgtgcatgtgcacgtgtgtgcgtgtgtgcgtgcgagtgtgtgtgatgtgtgtgcatgtgtgtgcatgtgtgtgcgtgtgcgcgtgtgtgcatgtgtgtgcacgcacgtgtgtgcatgcatgtgtgtgcatgtgtgtgcgtgtgtgtgcatgcgtgcgtgcgtgtgtgcatgtgtgtgccgtgtgtgtcatcatcctggtttgttggttccttccatctctggctattaatcttctttccattctgcaaaattacatgagttcaagaagaacttaggggccaggcggggtggctcacacttgtaatcccagcactttgggatgccgaggcgggaggatcacctgaggtcaggagattgagaccaccctgaccaacgtggtgaaacccagtctctactaaaaactacaaaaattagctgggcatggtgatcagtgcctgtaatccaagctacttgggaggctaaggcaggagaattgcttgtgcccaggaggtggaggttgcagtgagctgcgatcgtgccatcacactttagcctgggtgacaagagcgaaactccatctcaaaaaataaaaaaagaagaagaacttaggttagcttgaggtttctcagtatccacactatttattgacatttcaggccagatggttctttgttatggggtcatcctgtgcactgtaggatgtttggcagcacccctgccctctacccactagatgccagtggaaattctcctcccaagttgtcacaactaaaaatgtgtcccaatgttcctgggggagggggacaaaattgcccttctctgtctgagaaccccagattagctgaagagaactaccagtggccaaaaacgtggtgaataaaggacgtgggtgagctgtcaggaggatccgggcagagactggcctaccctgtgcctggaggcagggagatgaagaggttgtgcttgggagggcctgcctgacccccagctccaactctggtcagcatctcccagcaaccagtggggacctaggaggttgcaggtggtcagccctaggactgggagcaaagaggagagacagggaggtgatgtctgaaccaagtcctggaggatgaacagatgcaaaggcagaggtggagaaaggtgtgtgcgtgtgtgtgtgtgtgtgtgtctgtgtccctgagtggcccaagccaggagcaggacttgctccctgctctagggagataaaggggagaatatcacaacggaagggccttcctgctgctgagatcggatttcaattaaaatgattagctctgtttatttagactccacagctgcatacaatctattgcgtgttattgcgagtttaaagaaataaaggaggggcatggggggaggggaagcatttcagcccaaattgaaaaagtcctcctgtaattacgagactggagaatatccgcggaggggatcaataatgggaaatctaagtgccactgtttgccgagattacagttttgaatcgctccatcttggattttaattttctttctcattgtcgcatcaccctgagctgtgatcccagccccacctcccagcttcagagacgcaggcagtagggctgaaccaaagcagggaagtcagggcacatctgaccttcttacaaaccttttattgctgtgtaacaaatgaccacacacttaggagcttaagacaatacacgtttattgtctcacagtttctgtgggtcaggagcctgttgatggttcaactggctcctctgttcagggtcctgagaggcagcactcaatctgtctcctgggactgggtctcatctgaggttcagggtcctctttcaagcacatgggatcgttggcacaattcatttccttacagctgtagacttgtggcagcttgcttcttcaaaaccagcaggagagaggctctgatgtccaggtcttcttttaaagtgcttactgagctgggtgcagtggctcatgggctgggggcagtggtgcacacctctaatcccagcactttgggaggccgaggagggtagatcacttgaggtcaggagttctagaccagcctggccaacgtggcaaaactgcatctgtattcaaaatacaaaattagccaggcatggtggtgcatgtctgtgatcccagctacttggaaggctgaggcataagactcgcttgaacccgggaggtggagtttgcagtgagctgagatcacaccactgcactccagtctgggtgacagagagagactccgtctcaaataagaaaataaaataaaataaaataaaataaaataaaataaaataaaataaaaagtgctcgcctgattaggccaggcccatccagaataatctcccttttgatcaacttaaagttaaccatttagggaccttaatgacatctgcaaaacctcttcaactttgccatattcttttaagagatgagatcttattctgtcatgcagcctccacctcaacctcccaggctcaaggaatcctcccacttcagcctcctgaatagctgggaccacaggtgtgtgccagcatgcctggccaattttcttttgtttttagtagagacagggtctcactatgttgcccaggcttgtctcaaactcttgaactcaagtgatcctcctgcctcagcctctcaaagtgctgggattacaggcgtgagccactgtgcccagtcatctttgccatattctattaaatagaagcaagtttcatgtctcacccacacacaaggggagggaatcatacaatgggtgtgtaagtccttggggttcatcgtgcaattctgcctaactcaccttccattgagctctctctctccagcctctcctccccacattcccaaagccaggccttgaaaagacatcccttcctgagccatcctcaccaccacttgcctccctagtcccagcttgctgaactgaccccaataaacaatccagcagccagccttgattgaaagtcttcccaaataggagaagaaatgaagaaaacaaccaagaatatgacataatcctctgactttctgtccagtgctcttccctgtagaccaggtttgctcccactggtctatggtctcctctatgtcccaaacaccagccaggattcctggctgccctggcccagcagccttgacctgttaccgtccttctcaggctactgagcacaaggtgagatgcaactgagctcttccatggtggatgaggagaggagcccactgtcatcaaaagacccacacttctatcatgttgttgcctggcttccaagtctaagacggctgcttcagctccagccatcactcccaccatccagccaacagggaggaggaagggaaggaaaaggacatgtgctatgctttgagtgtttgtcccctttgaaactcaagccgaaactcatgttaaaacttaatctccggtggaacagtattaagaggtgggcctttaagaggtgattgagtcacaagggataaattcacgggttaatgagttatcctgggaatgggttagttatcaccagagggctgttacaaaagttagtttggctgttttttcttgtcctctcaccctgtgatgccctgtgctgcctcgggactccatatagagtccaaatgagcaagaaggccctcaccagatgcagtcccttgaccttgaacctttcagcctccagaactgtaagaaataaatgtgttttctttacaaattacccagtttcagatattccattacagcaacagagaacagatgccagctccctttacacatctccttacaccccattggtcataagttagtcacatggtcacaaatgactgcaaagagtgctgggatatgtagttttattatgaacagccctgtacgatgggaggatgtaggagtggatgtggagatttctggaaatctctgttctaacttccctctgcctggcttgtgtatgcaatctaagggatgggatgtttcttttgaatccagatccttaccctccctttcaatagcgtggcctatggttccattgctattgatggtttcatcaaacccattattcatgcattcgttccttcactcctctacctactcatttgttcactagttcattcatttagtctcagaaattctcttcctatgtctttcacaataccgggcatttggtcagcattccagacgtgcagagaatggtacagactctgcactcaagttactcagaagctagcagggaaaacagccaaggaaatgtatcattttagcaccatggcataggcactatgagaatgtgcagaagtcatgtaaacactgtggccctcatccatgtggggctgtgtgcaaggtttgcaggggaaggtgacaccccatctgagtcttggtcaaacaaactggctgggagcaaaaaggaaaaagcattccagcccacaggactttgaagaacagtgctggccctgtccgtggtgctgacccacaggcccagcctggagcccagtttcaagctgagatcaagccagtccctgtttctcccaccaacctacccgctctaggctggcacacaggggtgggctggtgggatggaagtgaggtggtatttagctacatacttcattttcataatgaccttcccgtttctcctcgcttgtcagtctgtgaccattaaattcctcattagcaaacgagatttggatgagcccattaagatgagggatggcctcacagtgcagctgcctggggtgagctagaactcaccttctccctccctattagaaaacaatgcacctcacattctgtgcacatttctccaggtctactacctagtccacacaggccccttggagttattcagaggaccagcttaagggacggccagggcacaacagaaaagcaaacagcaggacaactgtttgctcacacatatacccagagccacccaatcagggtctgggcgtttgctgcttcatgttaaagctcaaattcccaaatgtgacgttcaaacccttcccagtcctctctcagtccacctctccagcctcttctcctatcctccccaagtgcctctgcattttggcaatgacagatgacctgatgctgtggcatgctggaagtggttcataccagcacccagcttgtgagagctgctttgtacatactcaaaagttttgcaaggcaattggcagcttgaaatcagccgtggtgagagtatttacaccacaggaatcagcaaatgccacagttaaggttttctggcttttttttttttttttttttttggtcagaaatctggattttaggccaggcacggtggctcacaccgtgcactttgggaggcctaggcgggtggaccacttggggtcaggagttccagaccagcctggccaacatggtaaaacccatctctattaaaaatacaaaaaattagccaggcgtgatggcaggtacctgtaatcccagctactcgggagactgaggcagaattgcttgaacccaggaggcagaggttgctgtgagccaagatcgcgccactgcactccagcctgggtgacaagagcaagactccgtcacaaaaaaaaaaataaaaagaatgaaagaaatctggattttaaacatttgccaacacacccctgtctgcaggcctctgagcatgtcacgcccttgcatagccccctcgacctttaatgctgttccctctgccaggttccactccttcttcctggaatgcctcgccagtccctcttccctgcctggtgaaaacctagacatttgttcaggccccagggagtcatccagctccccattcagtgttcccacagtgaaagggtcttatgccctaggcaggacttctcgtcttctcttccaccttaaccaggacttctcattcgctttccattttggggaccacaggtgagcaccaccatgcctgggaagggagctaaaggaaaaagcagaactatgggggcaggaaagttcacaataccccggggcagaaagtacagctggtttcatggggacaaagaatatgtccagcaagcagctgccctttttattattattattagtattattattattattttgagacagagtctcactctgtcgcccaggctcggttcaagcgattctcctgcctcagcttcccaagtagctgggattacaggcgtacgccaccacgcctggctaattgttgtatttttagtagagacggggtttcaccatgttggccaggctggtctcaaactcctggcctcaggtgatccacccacctcggcctcccaaagtgctgggattacaggcatgagccaccgtgcccagccacagctgctctttttctagggccacctgctctctggattctgcatacaacaccccttatggcttccctcaaataatcaccctttgcccctggtttgcataaaatctcaggccaatcaaccacaaaccagagcatctctgagtctcagtcccaaccccaggattgtcccaggatagtctaatcatctgaggccatcaggcagggtgtggagctgggaaaacagcccatctcccaggctggagggcaaactccatcagcacagggaacatgtttcttcatctctaagagaagatcatgttctagctaagagaaggtgcttagtaaatatttgcagaataaatgagtcacctcacagtttgggtcctgctccgacgaacacatgacccagctggtccctggagaaggaggcaaaggctttgaggcattcaataaggcaacgctgcacactcaagtcacgaggcttccttgccctccagttactagctgtgtgaccttgggtgagtcacttaacctctctgtgcctcagaggcctcatctataaaatgagggtttcaattttgcctaacttagagccgtggtgaggattacagatgatcttcctggaacagctggagtggctcctggcgcatagtagacactcgacacagcggaagctgttgttccctgttctatgctgaaaccacaggacagggtccctctctgctccaccagcaggcttcctccccaggtctcatgtgactccagccagccacacacgctgaccctctgccaacccagccagacctctgttctcagggcgttaaatgcaaggggaaggccacgttgacaaccaactgcagccacgcctcctctgccctccccaggagcctgggctgaagacttcatctgctgtaattaacaagccaactgcagctgtcttgctccattaatagcagatcagcctgtcgggcgagggctgacagggaggttgtgaacagaaaggtaagaaggaagtgggccaggcacggtggctcacgcctgtaatcccaacactttgggaggccaaggcattcggatcacttgaggtcaggagttagagactagcctggtccatgtggtgaaaccccgtccctactaaaaatacaaaaattagccaggcatgatggtgggcgcctgtcatcccagctactcaggaggctgaggcaggacgatcgcttgaatccgggaggtggaggttgcagtgagctgagattgcgccactgcactccggcctgggtgacagaccaacactccatctcaaaaaaaaaaaaaaaaaaaagaaagacgtggacaggaccaggggcatgaagcagtggcatccagcctgcctttccacctccaccccttcccttaccccttctcctccctccacccctgaggctgactttccagaagccacaggctacagggaaggggaaagatgactgagtgacgggaacagcccagacccacctccaaagtgctcctgacagcaggtgggggttaggaacagagccatggcttggaggcccagactgtggagagcagccatgccctctccagaaacccttcctccccaagactcagccaggcaggagactggttaggggtaagggccacttctacctccattcctctttttccaaagatgttgcgattcctgcgacatgggaacacgcagctgctggtgaggaagaggtggcttcttaccacttaggtcaatgacagccacttcctccctttttaacaagcaggtacatctcctccccatcccccagcattgagtctagattcgcacaaattgttttgttactgttgcttgcacacaccagagaagaaaacagaagaaagaaggaacacagtgacccaggccccacctgtgctgaggggctgctggcctctgcgggtgagttcctggtgtgtctccttcccccaaatccctcccgggtctggctgctctaagcacgtgtgtgctcacaggcaggtacttgtgggctcgtctctgatgtatgcagcacacagacccctcgagtccctgcttctagccaggagccgtgtctttaatctcctcaccttgggaggcattgcagcactctggtaattgcttttggaaacatggtcaccagtttaattggtagaacttgtcctgggcggtgtaacaccaccaagcaacctcaggcctatctgtttctccagatgccttggcaggcacgtgactatacgtgcatgcaagctcacctgtgcattggaaagtatgtctgggctcagctgtgcattggagaggagtgtctgggctcatctgtgtgttgtgcaggctagctagagtgtgtctccaacctcagctaaaggcatggccaagatctacgggataagggagtgaagggctcctgagagctagtgggacaggatggaagagcaccagcccaagccctgggggacttctctgccttgtgaccagaaaggggagaggagatctcccacaaagccatccagacaccacctttgatgggctccttgcactgtgctggggagggggtgggctgtatatcttgctctgtgcccaaggaagaccgccttgaacctgttgagctcagccaatggggtgcccaggcagaacactgagagaaggaagggaagatcgtgagctcagcgcattcgtttccctgagaggcggccacgggctgagggcattgctcggctgaaagtcccagccccatcaagcagacccctcctcactgcagcgctgtcttgggtctggtgaccccctcctctcctccgtggtagtaacagtccccgctgacactcgctggagctccacactctcctctctggtgtcctgcacctgcccatgcctgcaaacagaccttttatgaaaattaccctcaaaacacacagtctggctgtgcctccacttcctgctaggacctcgaaggatccctcaggtgggaggcgaacagcatttgggggagacagcccctcctctcctgattgtttcttctctggtttccttctctgttgggcccccatggacagatgagcccagggtgagggtggcacaaagttatctcggggggacagggacagcccttctgcccctcgaacatttccctcccaagcctctgcaccagctctcccacaccccaagccaggctggccagccctaggcaggacacagaggggacccacgaccactcaggcctcctcacaagggccgctggcccacagctggaaggagggagcaaagtaggaggtcaggcgcgttggctcatgcctgtgatcccagcactttgagaggctgaggtgggcagatcacctgaggtcaggagttccacaccagcctggccaacatggcaaaaccccgtctctattaaacatacaaaattatctgggcgtggtggtgtatgcctgtaatcccagctaattaggaggctgtggcaggagaatcgcttgaacccgggaggcagaggttgcagtgagccgagatcatgccattgcactccagcctgggcaatgagactgaaactccggctaaaaaaaaaagaaaagaaaaaagaaataagggaacaaagcagcacctgggggctccactgaaaaatgagaggggcagaaggcaggaacctctggcagagggaagagcaggtgcccagcgggcaggacgggctcacagacagggtgagcaggaggagcagacacacaggcagcagcgggggacagaggagaggcaggcagggctgactgagtgtaggctgcggggctctccatggggtccactcttgcagcccagggagcgggtcagggacgcggcttcagccgtcagatgccagagattcccaggagcagttaccagggagcaaatcgctgtgctcccgtggagatgctgcaacccacccgcctgcgcccacccaaaggacactccacccacacgacccgggttatgagatcacctccatttcaccctgtgcccccatgccacgccccagcccagcccacacccacgccctccatcccggcactaacaccagcaaggccagaggtctgccccgccctcctctccctcctgcagggggtcggagcctgggggagagaagcccgcccacggggtcaccagccttcccctgggggactctgcctagcagaaggacccacaacccgtccagcactactgctaagacgctcgtgtcattcacgcccgggacgctcgtgatttatggactttaatttccccagatcctcagtggcttccctcctttccctctggcctgtcagggtgtttgtctcccagcacccccagcacccccctccctggtttttaatttgaagcatctgtctggagcatcccgaggaggagacgcctgcgaggctgaatgcatgaagcagctgacagctctattgatttcctctctcccaccgcataatgcaagatatatacaagccgataggccagccctctttgaagggtctgtgcccttttttctcactctgatgtcccctcaccctggcacatgttgatctataggaggggtgcttgtccctcatgctgaaaatgcattctcctctgcctcagtgttatttttctcactgttggtggatgaggcctcatctgtcctttctgtgcttgcagattggacacccaggaagcagttcttggagtgaaaggggccagtagggaaaagcaggggagctggggaggtgtcatctgtcaaaactgactctgccccccatggaggagatggtgcggggctttcggagtggccctccccagcctcacaggtctgggcaaggagggctgctttccactccagcccacgcctccaccaggttgcaggttttttcctccaaatccattggcaactcttgcctgggaatcacattcaattaacagccacagagccggctgctgggctaagcatttttctattcttggtgccttctggtttctcataagcagggcagctgcagacagttgtgcaggctgcacacaactggccgcagtggcctggatcctagcaggaattaatactcaacagaaactgaggctcagagctctcaggagactcattcaaattctcccagccagacactgaatttgaatctaagacttcctgcctccaggaagagttttcctcccaccctatcatactgcctcctccaggaagaccacctagattgataccactcaatctgatgcttctttcattcttgtcaccctggaacttatttgctatgagggtttgcacatactagcaggctcctctggaggtgttgggttttcaggacaaagcaatattctactcctctttgtgaatcaccatcgatgttactcctggaggactttcctggcctgtatcaccccttccccagcctgtatcagacccccatggcctccatctggtcccacaattccaaacacttcctacacctagggcccaacctcatcactgcctcccttactattctgtgtgtcccttgagatgggaacagggacaggatcttatttgtgcatcttcaccacttaggtacctagaggcaccttaaagacgtgccccatgcctctcctcccttctcccaccccagctccccaccccatcccgaggcttcccactggaaaaggtgtccccacccgctctgggctgacatcagctgccttgcctcccagagtagggacgaggctcctggtaactagagccgactgcaccccgccttgccacccgttgagcccgggcagaggcagcacccagggctgtcctccttacagcatccacagaaaagctttgaaaccctaggctaggtgcaaataagacagtagcctgagcccatgagttacctggccataggcacagaacagagatatccattatgaaaaagaatgtcctcgtggttttggccttctagtcaagcggctctcaaccacaagtggcattgccctgctttcccccggggacatttggcaatgtctagagacattttcgtttctcacaattgtgagggtctagcattaaccaagtaggggcctgggatcctcacaaggctcagaagagcctcagcccctaaacaaaaagtgaaagtgaccccatccacaaaggtcaaccatgtggggcgtgagaacccctgttccagtctgcctggcctttcttcgtggcttctagctcagcagcagggagaatgttaaacctgtctacctctcaggggctcacagactctttgggggccagggggagagtgagtaaccagtatccctttaaactcaccatcttcagtttctaaaaaaacaccagtgggccgggtacagtggcgcaagcctgtaatcccagtactttgggaggccaaggcaggaggatcgtttgaggccaggagttagagtccagcctgggcaacacaggggaccccatttctaaaaaaaagaggaaagaaagaaagagagagagagagaaagaaagaaagaaagaaggaaagaaaggaagaaaggaagaaagaaagaatataagaccacatgcttgtggtcccagctacttgggaggctgaggcaggaggaccacttgagcccgagaggtcgaggctgcagcgagcagcgattgcacctctgcactccagcctaggcaagagagcaaggctctgtctcaaaaaaataaataaataaagcaccaactcaccccgccacccgactccccatcctttcccaggtaaatgagttcagtgccagggaccagagtcccggcctgctgacaacctttaaggtttaataaacaactcccttccgagatggtttaaaggccagccctgccggcagccaaaggcaggggcctcttggagattaaatgagatggtggatatgaaagcactccaccaggtatgaaatcgcatacaaatattcccgataatttatggacatttctctccgcctgagctcccaggagtcgcgcggaaggggctattccgtttccagccgcggcctcagcgcccccgtgcggccgccagtggacacagcacccagggcgggccttgcctgagaggtgcgggttggagctttgcgaatcaccccatagaagcttcgctgcaaccctgcgaggcgggagagaggcgacagcacacacactcccacccccaaaacatacacacacgtgcacgcacacacacacagaaaccaggaaactaaggctcggaagatcaccgctgggcagtgaaggaggtgctatggaccccagggatgggcccttgggtgacgatgaccacagcgggcataagtgaggctggaaggggaactcctgaaggccctgaactccagcccaactccccctccagcctcttctccccgaccccctgccccagaccctccttacctctgccacactgaacttcccactcattctcagaaacaccccgcattctcctgaccctgggctgacgtcagctccctccctccttctgtctggaagtccttctccgggcaagctgctgcgcacccctctcggaggcagcagactgtgtcccctcctccacgaagccttccaggactccctcaggaggaattagacccctagcctctgggcatcctccacagcttattatgggatcccaacagtcatgagtgtttggagcaggaaccgcattctgcttattcccaagcccagcccgatgttcaccaagtgaacggaatggattgaatgggggaaaatcctggaggttgggaagtcttcccagccatgtgccgtgccagccctctgcccacctgcgagctggggcattggggtttttttgacccatcctggtcctctttccaatgtgtccctgaaaactgaagagagaactctaaaccatttggccttcagaggtggccagagtggggctgctggagggaggaggggaggcccggtgacttctgaggccctctctgcccagagccagcagagtgagggaagggaaggaaggaaaagggttggattgtgtcctgtagctccggacatgccctctgagcctctcctgcctccagccatgctgcaacacactgcttgagaccctccctaccgcctcttgacaacagcaatagccctcaccatcccacagctgccagcactggacattccagcctaccaatggccagagcgaccataacaggcagcctgggccatcctgccctcgagtccggggctttcctctcctgcaggatccaccctaggccctggagagttttgtttcatgtgtatatgggagtcatcagggaggctcatgtccaggtcagcatctgctcaaggtctcaggctgtggcactcagggcctaggctctgccccccttggtctctgacagtccccggccactccaggacatttggggctcatcttcccatggagcagggaagcgtgccctctgggcaccttgcctcacttttagtagctgcagcttattttgctatttgtcccccttggggagctggaggtctttggtacttgaacaaatttgccattgtgttttgctactacacgtctatggtcccttaaattatacaactcaagagggtgaacatctgtctccctgggatcgctgccaaaagggaggtgcagctcctccttctatccccgtccttgtcctgtcgggccggcagtgaggcaagaagcaccagtcattcattcaacaaatagtttttggacctactacatgccaggcactgcttcaggcacgtcagtgtctccttctggctctccctgaattcctccctccatccaccacccctttatatggtgagtgatctcagatgccgcatccagccggatcatcctgcaatgttagcattgagcacttactgtacagatgggtactgcacttcgagagttatcgacagaatgctgagccctgtccttgccttcaaggaaaagtggtaaggtggggcgtagtggctcacacctgttatcctagcactttggggggccgaggcaggaggatcccttgagcccaggagttcgaaaccagcttgggcaacctagggagaccatgtctctaaaaaagttttaaaaaattaaaaataaaaagagtggtgcgcatgtatgaaaagttaaacacctccacgcagcctacggagaagtgattgcaaggaaccactgtatgagcggcaagcaacataagtcaagggtgaagggtcctgcctgaaaaaggggaggcgggagctgagctcggaaggaccagtggcacttggcatcagagtggacagcagagcaaatacctggagggcagaaagtgcccaaaagtgcccctcggcttggctgaaagggtggttgcttgtggaggagcagtggggtagaaaagaccagaaaggcatcgcctgagatgggaagggctggcaaagccgggctctgaggtatgggaaaatccttctcaggtcagagctgaagcactcgtgcttctcagatcggatccgaccttcagacatctaaaattaggcttctgccaattaacttttcccactgctagaaccccgacacatttacagttgcagagacatcgttcagcttctttaaaagactcttcagtgttattacaatatttttgtgatctctctgcagcaaggtctattggttcctgtatctccagcacccccaggaaggtgctcagcctgagcttgttaatggaagggcaggagggaggaagaaaggaaggttaagttaaataagttctaagtaaagctcatggcaaagtgttctttcccttcaggagggccgctctgtaataataagcacgaagcaattacattctgccgtgtggttattaaattttggggaaacaaatataataaaatgtagacatttgtagggaggttggagataaaataaaaatggaggataaaaataaaatcgataaccgcaggttgctcagagtctaacctaaaggatgttagggggagaaaggaacgctgccctccccaggcttcccaagcctccccaggaagtggccggagcctgggctggggaatctgcccagcaggggttcaactcctgagtccacctctcccctctggggccgcggtgagaccccgcaagagcaggagcactcccactcaccatcagccctaggggtgagacacttagccaggggcagcgctgcgacagcttttggaagtattattattattatcattattgctagagatggggggggggaggtcttactaggttgcccaggctgctctcgaactcctggcctcaagcgatccgcctgcctcggcctcccccagtgctggggttataagcgtgagccaccgcgcccggccttaacttgctttcattgtacaccaattcctaagggaattggaagcagcaagcaggaacgctccctcttatggaaagaagagcccagggccctggtcatgacaggttcaggtgccaaaaaggagacgggaagaaaacgtgaggcgccagaacaacaggttctacaaggtgcacacgagggtccctgccattgaatgaagaattttctgtgtggatgcccctgcgcaggtccaatgaaagccgtggagaataagcgttagctcttcaaactgaatctgagctaaaacctagcaaagccaggctggggtctgaggggttgcgggggaagacaggaaggggtggacggggaagaggcgggggtcctaggaggaagggatggggaggagcgagaggagggaggcggagggagggcggcagccaggatggtccattccattcttggagctgcactgttgacttcgaccacaagggggcagggctgctgaaattggaagtgcgaacgcctacatgagtcttgatcctcggcaggcaccgtacccagtttcctccgttgggagggtttaactgcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatctttagctaatcgcgatcatctcagaggccgccctgagttcagttttctttcgtataatatagtaaattgtcggaacggaatctccactccgcgaaagcctcaaaacacacgtcccataaacactgtttaggttctctgcagttgtgcaaaatcttaacacaaaatccattttgtaataaagtgctggatatttgcatgtaatgtatcgagcacggcacactgtgtagtatggtcgtttacctcgtgatcctgtggtcgctggccagtgtcagaaggtatcatacctatctaatccagaaaaatatttaaaaaaatttttttttttctttgagacagtctggctctgtcgcccaggctggattgcagtggtgcgatcttggctcactgcaattaccgcctcccaggttcaagcgatccccctgcctcaaagtagctgggcgcgccaccatgcctagctgatttttgtgtttttggtagagacagagtttcaccatgttggccaggctggtctcgaactcctaacctcagatgatccacctgcctccgcctcccagagtgctgggattacaggtgtgagccactgtgccccgccaagatcaaaatttgaagcagggcttctactgaatgtatatcgcattaccaccattgtaaagtcacagagtttaagttggactgtcataggtctgtttcccagcttgtacatacaggggaaagaaggtgattaatgaaaaaccttaaacagcaggttttcgatggataggtgccaatctctgctgcccacttacttaaatttttacaccaagtgtgagaggtagttgtgttactcctttgtgatacttgaaggagattgggggggcttgtgtttgatacaagctaggtcttgagttatgttgttactttaacccagtcatcttttttcagctgactgagaatcaggtcacatgtggaagtgaggttgcatgggacaggcctgttaaggtgggctaagacaccagccgtctctaatgctctgccagccgtggtgccagacggtggttggtgtacagggagagtctttcaatgagttgggggtaggcagagatgggggtcatatttgtgtccccattacccaaaacaggctgtcacctttgaggtagtgaccacctgtggggacaaatagcatctggtgggaatgatgactgttggctagtgttttgtgtaaagagatgaggttatcaggtcagttttatttcagaccatatggggtcactgcctagtttgaagcccaactctacctgcaggtaacttacccttctcagcaagttaaacacgacaccaccgtttgattgtgttttaaaagggtggtggtccgggcgtggtggctcatgcctataattccagcactttgggaggccaaagcggacagatcgcttgaaccaggagttcaagaccaacctgggcgacatggcaaaaccccatttctactaaaaataaaaaaattagccaggcatggtggcacacgcctgcagtcccagctactcaggaggctgaggcaggagaatcagttgaaccaaggagacggaggttgcagtgagctgagattgtctcactgcactccagcctgggtgacagagcgagactgtctcacaaaaaaaattgggaaccttcattttagatgatgtggctttaaaggtagtggtcacagtcccctggggacagtaaagtgtcagtagctgtttgttgaaaaaactttttaaaatggttgtattaatttttaacgtgtaataggcatagcgtaaaagttaccatttacactgggtatggtggttcccatctgtaatcccagcactttgggagactgaggcagatggatgagactagcctgggcatcatagtgagaccctgtctctataaaagaaaaaagttagccgggcgtgtgctggtggtcctagctactcaggaggctgaggtaggattgcttgaatccaggaaattgaggctatagtgagccacgattatgctactgcactccgggctgggcaacaaagcataattgtacagttcagtggcattcagtaaatacacattgttgagcagctgccaccatcaccgcccatctccagaactttatcttcccaaactgaaactccctctgttaaacaccagctccccattcttccccagcccctggcaaccaccttccaatttgtccctgaatgtgactgctctggataccccatacaagtgggtctgctattgcatatttgaccttttgtgactggcttctcttcacatgtcctcaagcatgtgtcagaattgccttctgttttttctttcttttttttttttttttttttttgacatggaatgtcactctgttgcccagactggagagcagtggcggaatctcagctcactgcaagctccgcctcccaggttcatgccattctcctgcctcagcctcccaagtagctgggactacaggcgcctgtcaccatgccgggctaattttttttttttttttaaagtagagacggggtttcaccgagtgagccaggatggtctctatctcctgacctcatgatccacctgccttggcctcccaaagtgctgggattacaggcgtgagccactgtgcccggcctgcaatttgctttttttaaacagggtctcactcctgcccaggctggagtgcagtggtgtgatcatggctcactacatccttgatctcctgggcgcaagtgatcctcccaccttagcctccagagtctctgggactacaggcatgcgccaccacacctggctaatttttggtgttttagagatggatctgtgttggccaggctagtctccaactcctggcctcaagcagtcctcccaccttagcctcccaaagtgctgagattacaggcaggagccaccacacccagaccggagttttcttttgaaggccgagttttccattgtgtgggtaggccacggtttgtttattcgtctattgatggacattgggttgcttctacattttcgctagtgtgaataatgctctgaacatgtgtgtgcaaatattcttctgtggttgctatctgttctttggggtatatacctagaaatggaattgctgcacatatggcaatgttgagtaaactttttttttatttattttttttttgagatggagtttcgctcttgttgcccaggctggagtacagtggcggaattttggctcactgcaaactctgcctcccatgttctcctgcctcagcctcctgagtagctgggattacaggcgcctggctaatttttgtatttttaggagagacggggtttctccatgttggtcaggctggtctcgaactcccgacctcaggtgatccacccacctcagcctcccaaagtgctgggattacaggcgtgaaccaccgcacccaactgaataaacattttgaagagctccatatgtctttacaagtggtgttcagcttagttcagctgctaggggcagtgttatactgaaataggttagtttggatgaatatccaggtgtctggatgtattaagaacgagagtccaggcagcccgtgccttgggcaggctctgagtcacagtgctgcttcctctgatgtgccccattcctatagtagttactggcagaaatggagttgccgaattgctaggacaagatcatcttgtgtgcgtctgccaggttaagtgctgtgtgctgtgtctggccaggtgctttcgttgaagtgttagagcccatgttcagccctcagccacctgcttcttgattggcacatcactgctattataacaaatcctgggagtatctctgagcagtttttaaagagttggaacaaggcattcagtgaatacatggagtggtaactactcctgggaaggggttgtctcacagcagccagatggccatgcattgatactgctagtacataaccagagtggtgcacgattcaaaccccacacagctgaatttgaggtacacagtagctgtttcttgtctgagccatgatcctgaaatagaacttggcagcaggaaagaacccagaaaatggattccacataaattcaaggaaaaccctgggtgcgtgttgtgcgcagtggctggaggcatcctgaagaacgagctcttactggcccagaatgtcatctcacatgcggaggcctgatttccgggagtggagtgctgaaaagcgctcagtcccagcagacagcccgtctccttactttatcactgcttctatccctttttaaaaagataataggccaggtgcggtggctcatgcctggaatcccagcactttgggaggccgaggccagcggatcacgaggtccagagattaagaccatcctggcaaacatggtgaaaccccatctctactaaaaatacaaaaaattagctgggtgtggtggtgcacgcctgtaatcccagctactccaggaggcttaggcaggagaatcgcttgaacctgggaggcggaggttgcagggagccaagattgcgccactacactccagcctggcaacagaccgagactctgtctcaaaaaacaaagtagaaataagaaagataataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccggtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtctttttttttttttttttttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccgaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctggggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcaggcctccagccttctggggctcccttgccccgggttcaaagtcagtcctcggtgaccacccactgcctaggaggcaggcccttcccacctggggggcctctgagggcaggggctgtaaaagcagctaccagaagagtccactttccccagcaactgcagggactgagtcagagaccaagaccttttaaaaggaggttttcacccaaagaagttccctcccctgccgcagtctccaagctgatcgcctggctcctgcagttctccggctccctgtcctgttctggaacttgcttgcttccccttccactggccttagtccctgatctcacagggtcctgttccttctgcacagaggcctcccccagcacccccctctttgactcccgatcatccttcagctcatgtcactgtcctttgggaaacaaccctgacgcccaccttccatcccctctccctacagcagggactctgacatttcacaaggcctgcaatcgctgtttgcaggatacaagtccacctcacctcgcctactaggctgtagacgccatgcaggcgggaacgtgtgttttatccattactgtatcctctagaacagagaacgtgctcaagaaaatttgttgaaagacaccccaatgagagaagaatggctgtttccagccttccgggcccctcagctttgggctcctgcagggccccagaaccgtgggatcacggccacgaggagaggccccgaggccaggacttcctctaatggacacagggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctgactcctgcttgtcctgcagcctgggctcctccctccgctggccaagtcacgccaagcagtttgcggttacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgatctgatcataaataagaagcagcccggggacctcgagactgaaactgatttagagacttctgggagcttttttcacttccctcctcccatccggccaggacagatccccgcccagaaaggggctgttgactgcagcgggctgcgcgcccagaactgggactgggatcgcggcggggcggggcgggcgcgggcccagggagaggcggggccgggggcggggcgggcacggggccccggccgggaggtgagcgcagctgtcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggaggtaagtttacgccgccccagaccgcagccacgcgcgccccaagtccccgcactaccccctctcccctcgagagcctgcactttcccacgtgcctctcagaccccttctctccccgcgcagccctttcccgtctcccctctccccttttcccccaccctcccaggcccgtggcccgcgtcccctcctgtctgggaacctgggggccgggaaaactgaagagatcagagtgaagcgagcgtggggaaggggaggaagggcgcaagaccgcctgcggggtgaggggctgaacgctgagcgggcagggcggcgcgggggaggggtaaggacaggggcattcgtctcggggtaatcctggcgcgcgaggtgcggggatgctgaggggtgccccgaagttttcgaccgtctgagattccaagatggggcgctctctttccggggctgagtggcctaggaaagtttggcagaaactgagtagagtctcccgagtcggtcttcgcagcacccctcctccccagccccggcctgcagggtgggagtctcagctggaaggctgcagggcttggggaagcggtgtgggtcacttcccctctagcgcagagaacccacagctgcttgcgcttgttccagggaaggaaggtggcctccgtcagcccatctcacactgttgtcctgaggacccccttgcattgacagtcagcttctctgtgtcccctggtcctagactggcccattcctgttcccccacgcccctctctctacctcacacctttaagccctgaatttctggcctagggcagtcactcccggcttccccgccctttccctactctgctgacccttggcaggattctgcaccccacaaacagggccagggctccccagacctccctgcccagacaaacaaagctgcagaatctcccagcccgtctcaggtctggtcacgcctgctctggccccgggagcccacctgtatcagttccttgtgttgggtcaaagattctggggccagtggaccaggatgaggtccatttattcagagccaggcgcccatctcaggactttggcccccggcggcctctccctgtgtcaagttctccagatatgggacagatcagggcaaagcagggcctcttggagggaatcctgatccagtgtgaggtgcccaagcgccagtgacagggagtctaataataacccctgacgacccggctgccatcaggcccaggcagatggtgcctgccctaccagagggaggggagcatcaggaccccttcctggggttcagtgggcactcaggagcaagacggcagtcggtggacccacccccctcccccagagcccagcctgtgggagtctgtgttccctgagaatgtggctgcctggggatagctccagggaatcttcctctcccagagaatgcatgaaaagaggcggatatgatttcagaaacagccgtgtgtgtgtgtgtgtgtgtgtgtgtgtgtgtgtccccatcccaaaccctgtgccccacatcccacacccggggtctccagccatagttttctcctctccactggaggaaatctaaacttttcattgggtcaagaagacccctaggtgggggtagggatggtaaggggactccctcaccctgatggccccagagacagttcctatcagcccaacagctgtggctggtggatcctgggcctgcccacagccccctcagtcccatgggcaggtggcagttgagccagatgaacctacctccagcctctgcccctcctcccaggattctggccccggctcactttgtgctgggcatcaaatggttccagagggtgtcccttcccatcggccactgctcctgggcagctgacaccagccctgcccactggctcctggtcccgctcaccccctcaccaccactcagatcgctgagtaggagatgagcgtggtgggccaggaccggaagtctggctctgggtgttatttaaggtggctcctgtttttggtaagttcccctgttgtgaccacaggtctctcctggatgtcttctttcctcctgagcaccagtcactaacagagtcaggtggaccgtcggtcatcccagtcttcagcaagcttgactggagcaagtgctatgccaggcgtggggtgaccgtggtaaccaaggcagcaggtcttcaggagaaattgctggggattttctgcggctgggctctgggcgcagtgctatggcagacaccaagcagtttgaggtggggctctgccctccagttggctggggtggattcccagttctttccatgtgtgaccacgggtaggtgtcttaacctctctgagccttgttcccttcatctgcaagaattagatgagatattccacatatcatgcctagtacagagagtcccatagcacataacaggagccagtgacacagatcattcaatggagtggctgagaggttcaggagtgtgtctcaggacagtaccctgctggggaatggagaggaaggagatctcttccacagactctgattgggggagactgaacaaaacgcctgcagaaagggcttcagctcatgccccacatgttcaaatgcacagtgctggctgtgtggggtgtggggggtgggtgcgtgtgcatcagagactaagcaaggatggaaacaggcaggtgctggccttaggatgtgggtggtgcgggggatctcaaaggcaagggggttcttggaagtgcagagatggtgaagagcaggtcacctggtgagctgggatttcctgagcaagttcagtgttccagaaccttcctgaggaagtaggggctctcactcactttctggggtgtttgggagccgtgaaagcccccagtcctcctgatagttgatcctcacccctctccccccagtgaacttgagcccaagtcctcgcaaaggccacttggcctgtgtcaccagccttgtggggaggctaccctccagtgagtagaggcatgagaggtgagcaccaaggcagggctgtggacgagggcaccttggccctggcgggcacccagctctgggctgccagatgtggctgtatgtctggaaggaaatcagcctagacctgcagcccaagtcttctcacctttgacagatgagggggattggatttggagacgattcctactctaaagagatgataaaagaactaatgagttcatggattatgaagcctgtggccagtgcctggcacactggaaactgctacaatcactgcttaggaaggagaagactgcagccagccggtgtccactgggcagtgttggggagaagggaatgggcacctggcactgaatccagcaatgtctctctgagcaaatgaacgaggcacttcggtgtccctgcctgagcgtgagtgccaccatcaccatccagccagcccctcaggggagaccagacactgatgagctcagttcttgaaacatcttagtaagctcccaaaggctgtgcaaatgttagttattgctactgtcaacaggcaggtggccacatgtgtgcttcctgttccagcttcccttgcccaggatcagccgaccagctgctctttggggacatgtgttaggaggcagaggagatgttgttaattttttttgtatttaggcatgtatttccacgtgttctctcattggttggttccgttcatagattcgccaaagtacaaagtggagggtacacagttggggactggaccggaactacaggacttcctgcttctgacctgggggcaggtctgaggaagaaggaccaggcagcaagcccatcccagccgagatctgagaagagctgaggttgggatgaggaagccccattcatccagtgtgaaattgagtcacggtcatcagacagtcatgccgcgcctgggagagggcttaatctttcccagtgggcctgggagggagactctccctctaggtgctcctagtttccctctcccagcctccccctgagaccggcacacctctctctatgtcttctggggccagggctgttgccccctcccctgcccagtgcagaagccccttgggtcccgctgccatggtcactgcggcccccaacttgggtcccagcttggcactctccgctctgggtttttcatgacacagtgacaaatcagaaataattgaagtccctttgatgaggggagaggcagagtctgagcaccagtgtgggagctgggggcctggtgttgctgtgggacaaggaggtggctgcagggcacagtgggaggcgtggggaggcgtgggaaattgtcttggcaaagctctgtccatctgagcaggggggcctggaagcagaactcttggctccctcctccattcccctccacctccatgcacatggggacatgcagtgttaattaggagcaagaaaataattgcccattaggagcagcaggtgccaccaagctggccctggaagagggtgctgctggttagggggaggggggtgggctcctacctgctcctcttttccctcctccttcctcctcccttgcccaccttccctcttctttcttcttcccttcccaattccttttccccctacaccctctcaccctgtcccacccaccacccccagttttttcccagcacctaggtagggttcccaggagggtttgggaagtaactccctaacaaaaggcttccaaaggctgggcagggtggctcatgcctgtaatcccagcagtttgggaggccaaggaaggaggatcacatgagcccaggagttgaagactagcctggccaacatagtgagagcctgtctgtatttttttttaaaaaaaggaaatcaaaaaaaaaaaaaaatgcctccgagtttgggtttctcaggcctcgctttcactggagctggacagcattatcagaaacctaattgaggccagctgcccagcttggagaggccccaggccacaggggctcagcggctgccgaagggggagaccgggaggctggaggaggcttgagagagtgaaacgggggagcaggctacatcacccacagcctgatccttctcggacgagccttccttgctgggtggggacattggtagattcaggagcttttcccactggggataaaatgatagtgggactgttcaggaggcaaactcaaagggtagctgggggcaggctggatggtaactgggcttcaggctacacaggtttgtctggggctcccttacatttttgtgttattaggaataacttggttgggcgtcgtggctcacgcccgtaatcccagcactttggggagccgaggcaggtggatcacttgaggtcaggagttcgagaccagcctggtccttttgtagtaaaagtacaaaaaaattagctgagcatggtggcacatgcctgtaatcccagctactcaggaggctgaggcaggagaatcacttgaacctgggaggcggaggttatagtcagccgagatcacgctgctgcactccagcctggtgagagagcaagactccgtctcaaaaaaaaaaaaagtacaaaaaaattagctgggcctggtagcacatgcctgtaatcccagatactcaggaggctgaggcaggagaatcccttgcacctgggaggcggaggttgcagtgagccgagattgtaccactgcactccagcctggcgacagagcaagactccgtgtcaaaaaaaaaaaaaaaagaataacttacaggaaagagtgcagtcttaagtgtgcagttcagttcaatgaatttataccctcgagcacctgcgtgcgtggtatgtgtgtgtgtgagcaacaccatcccaatcagatcgtattcctgaccccctagaagcccccttcgtgctctcttgaaatccgcaccctcccaaaggtagcaatgattcggtgattcacatttctctggctactcatgagtatctctgactttgaacttcatataaattaatccatacagttctctgctgttccatgtctggctttctctctcaacctgacttctgggaaattcatcccagaaataccgtcatgtgtggctggtttccttttcatggctgtatagtattctaagactataacacatgttctatatcttttctcttgttggtggacgtttgtgtctttttgggtgtaggctgtgactgctgtgtgaagctgctgtgaacatttgtgtatcttctgagggacacagccctcctttctgtaaagcagaattgctgggtcatggcatgcatgttacacaatgatttgcaatttttttttttttttggcttggttggggttttttttgggaggttgggttactttttttttaagaaatgggatctcagcatgttgcctagcccaggctagactcaaactcctgggctcaagtgatcctcccatcccagcatccccagtagctgggattgcaagtgcatgccaccaggcctcgctggtttgcaaatgattaagaggatccctgggctttagcagagaggcctcaggggctgccaaggggcggccaggacagaacgtggcatttctatccactcctcactcagatggagctctgtgttgcagggctctgctaagcaagtcagtttgaagaaaaagttaagctactggaaaaagtttgagaacttctgttgacactaatccagtgctgcccagactttaatggaatatatgttgcctgggatcatctctagaggcaggtctgattcactagctccagggcggggctagagattctgcacctctaacaagctcccagaagatgtcagggccacaggtcacagggtggtaaactttacttcaaggaaagaggctctcaactcccagctgtcttggcctcctctgcctgggcctgggctgcagggccctctggtgaaggggcatggactgaggaccagaagaggggcagtgactttccaccatctctttctatccctgggcttgctggggtcagtcccggggacaggccatgctaatgagtggtccaggtggggagagccccagccccagccccctgccacactgtgaggtctttgggagagggaggtgcccagatctactgggccctggcttcccagctgccactttttttttttttctagaagggatctccctctgtcacccaggccggagtgcagtggtgcaatcatggttcactgcagcctcaacctcccagtctcaagcgatcttcccacctcagcctcctgagtagctgagactacaggcagatgccaccatgcccagctaattttttattttttatttttttgtagagacagggtctccctgtattgcccagactggtcctgaactcctgggctcgagcaatcctctcaccttggcctcccaaagtgctgggatataggcgtgagccaccacacctggcggaaagccacattttccaaagtcaaatccatctgttcccctcccaagtgagccatctctcctgcctttttctgggctgcccccatcacttcagctgagaagtctgtcagccaagagtgaccagcagagcagtccatgtcagaggcccgaagacctgcccgcatctcacagggctggcagcgtggcctccagcaggtgtctgtccccctggaaaatggccccaaagccccagactgcagagcccggccttggtttgtcaggtctatctctgtgtgtgcctgtccctgcacaagtctcgtctcccccttagaccgcagggtcctggagtacccccttcctgctgattgccaccccctgcataggactccctgaaacaggctttccccagcagcacccccagagcactagggattcgggactgggaacccctattgggggtgcatgggaagcaggggcggctgtcagctcaggagcctgacttagagccaggtccagccctggctggcggccgccaatcccggtgccatctggtgcctatctggcaaaatcaagagatgaatgagcagagagtggcaccaggcctcctgacagactggctcccattgcagggccccgaggtgctaggcaggcctcaggcccctccggccccctcagaattctggctttgctgctgcctctggcactggaggttcagctgtccctggtggggtgcagtggaagggactccagaagttgcatatcctgactatcccgccccctcacacatcccccaagcatggagctggcttctcgattctcaggatggaccccaacacctagaacaagctcttcacattctggtagaggatgatgcccagcctgggacagcggggtccttgcatggaagaggcaacagatacacagggctgtccttccaggccctgcctcagtggcactcagcgcccgaggcctctgggtactctggtcttggacggtatccctctccttgcctttttcccttggccatggagctcaccacccacagccctccctgctagctggggattcctgccttgtctcctgagtggctcggactcttcatcagcagggcctggtccgtatcttcatccagggtctgaaccagaaaccggagaccagctctggcacccctccctcactgaccacgaggcccaccacttggcctcatgccctgtaagctccatcactcccacccaagtgcctcagcgccgggccctctgtttacagagtaggagcttgaaccctaggtggagcttggaaggatggacgagagatgcagctcaggcagtggggcactcagggcccaagggcagggcacttccagagccccgcactgcagggatgaagagtgacaacaggcctctgctctcttccagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctggtgagtgtccctggacgctgggcttggggtgtgtgactcagtctgcaaggggccagggactgtttgaccatgttctgacggagctccagctaccttgatggaaaagcttgtccccagatgaatgttgtccctttttttttttttaccaagcatcaggaatcagatgcctggggtggtgatggggtctccagaaaggtctcccaagtggccccccacaaaccctgccccaatgtgggtttgtcctgtgcccagcagctgtgcaggcagcatttctgcaccgacactgggcatctccagtctctgtccctggcccctgccagctgctgccctgggtctgtgaggtcagaagaaagtttgactccagcacaaatcaattccatcttcttgtgagatcaatagcttttagtgccgttagccagttctttggtttggatgaggaagggagaatttcttttatttatttattttaaagatggggtctcactctgttacccaggctagagtgcagtggtgcgatcacagctcactgcagccacaaactcctaggcttaagcaatcctcccacctcagcctcccaagtggctgggactacaggtgcacaccaccatgcctgcctggctttttttttggggggcggggggtgggcggggaagagacaggctttcatcaagttccccaggctgatctcaaactgctgagctcaagtgatccacctgcctcagcctccaaaagtgctgggattacaggcgtgaggcactacacctgggctgagactatgttgctcaggctggtcttcaacttctggcctcagacattgctcccccctcagcttcccaaagcactgggattacaggcatgagccaccatgctgggccttaaagtgaggatttataactcccgtgcaggagtccatacccagcccaccacactgcctggccactccaccccagctggcgtccacatgcatgctggctgttttcaggagttgttgcgtttttcttgtttttaaatctataatgatttttccaaaagcctctagtgtccacgcagagacgcttctggggtgtggtcaccccagagagtagagtctcccactacctggcagcaggctggcagccaggcaggtcctggtcagcctgggggtgaggatgcctgggctctcatacccaggcagctcaccttgccactgcgagtttcttctctgttggaagatgttcttgatctcgtcctgcctgtagtgggaggctcacctaagccaaaacgcaggcgagacgctaaagcagccttgtggggcggacaaagctctgagcacaaggaaggggaccaaggctgctgcaatacatggccggggctgaaataagagactcagaggacagagttctggacaggccgggaggtcacagtcgagtgcggttcccagtacagtggaagagctttgagaagtgactggtgttaaaaatcctcctgcatggccgggcgcggtgactcatgcctgtaatcccagcactttgggaggccaaggcgggtggatcgcctgagctcaggagttcgagatcaccttgggcaatgtagtgagacctcacctctacaaaaatgagccaggcatggtagtgcatgcttgtagtcctgactgaggcaggaggatgatgagcccaggaggcagaggctacagtgagccatgatcgctccatcgcactctagcctgggtgatgtgagaccctgtctcttacacacacacacacacacagatacacacatacatgcacacacacagatacccacacgacaaacttgttttggaagaatactttggaacagtaagaatggcatgaggagtcaattcttctaatatggaagaattatctgcagtgtagggaaaactcaaggtggaaggaatgtgcgtggcagaatccatcccacaacattctgggcgtgacttgtaccaggcaagagggcaccagcagtaagaaaacaggcaccaagtctgctttcatgatctgtcagcagaggctgagaactgtgtaccagtttgctttgaatcattgcaactaaagagagagggctgggcgtggtggctcacgcctataatcccagcactttgggaggccaaggtgggtggatcacttgaggtcaggagttcgacaccagcctgaccaacatggtgaaaccctgtctctactaaaaatacaaaattagctgggcgtggtggcgagtgcctgtaacctcagctacttgggaggctgaggcaggagtatcatttgaacccgggaggcaggggttgcagtgagccgagattgcgccattgcattctagcctgggctacagagtcagactccgtctcaaaaaaaaaaaaaacaaccaaaaaactaaggagagagctctgaaggaaaggagcaggcatagaagtggatggcccacctgagtccaggcgttcctgggtgacatgggcacccaaacccataggatgagaaggcgttaacttggcaaaggtgggggcaggggaggcggagacacctccaggcagagggaagaggaacgtgcaaaggcccagaggcaggagcgagcatggggctaaaggaagccaatgtggccagagcagagggagcagatgagggggttgggggcactgtcgagggtcggggtgagcaatgagtggcagtgggatggggaaagtgtcacggggtcagaagacacagggggcagatgggattcaaaccatgaagcaactcataggctttgtgaggggtcggggtctttattctaagagccaggggagccactgcaggggctctgcaaagaggtagcgtgacccgataactcaagttgaatgtaacccaggccggcgggagtattcggaacagtgggacttgaatgtgaagaagtggccaccgggtgaccgaagagctcagaggcctaatgagggcagtgagcgaccttgggattagcaatagcaggagccaccaccacctgcaggccagagggacacagggagaggctatgtcaccagggaagctggagccacacagcctgcctatcagcggctgcagaacgaggggagcagggccctggctgccttaccaccacctccagtctcctaccagcacctccatcggcagaagccagctggcaggggagcccgagacattccgtgtgagggatcaacccctgtaatggagaacagggcaggggacagaggagggacaggtccaggcagagggtcgcatagatgcgggcaagagtaaaatcaggccatcagggaggcccagctggagagcagcgggcttacacctgggcgtgggcagtgaccagaggggagtgcccagaggaagagtcagctagggaggtttggggaggagctgctgaagttcatctgcaggtttctggcttaagcccccggatggggtggcagtgctatcctccaaggcaagggacattggcagggaaccgggaagagaagcagacagtcagtttggttgtacacagattgagtttaaggtgcctttgaaccatccaagtgcagttggagttataaagccagggtcatgagggtggccagtgtggaagtcacacacatgggtgacctgccataggaagcacagagtgagaagagaagggggctggggccaagcctggaggaagcacagtgtttaacagctaggacgcaaaaggtgcctgtgaaggagaccaggaaagagtgtcccacaaggaagggctgggaatgccacaagggcacaggagtcactgggcagcgtgttccaggaagaggaaccaagctgaccactgcacgtgggaggggggttgggaaaaacccttgggttaagtgggaggtcattggtcgccttccttggagctgcgtccactgggacacaggaacagccagattggtgtgagttatgggaggggcaggaaggagagtcgggacagcagcaggagaagggatggaggtaaaggttggggcactgaggtgggaggacacatgagctctgctgatgtgattccacctgaaagcgggggattgaatccgcagaagaaaagaccaacaaggggttcctgaaaaagcaaaagggataggaggatatacctctttgttctcctctattatgggggaagggtagtgattttatatttgggaaagagtagtgtgaacacaccagggggaaagcaacaccaccaactcgcttattctccctcaagcagaacagtttttcctatggcccaggtgggatcaatgaccccaggagagaccaggagaacctcattaaacagccaaggcgatttttctttctttcctttcttttctcttcctttcctttcctttttcctttcctttcctttttgacagagtctcactctgtcgcccaggctggagtgcagtggcacgatctcagctcactgcaacctctgcctcccaggttcaagagattctcctgcctcagcctcctgagtagctgggattacaggcactcgccaccatgccccgctaatttttttatttttagtagagatggggttttgccatgttggccaggctggtctcaaactcttgacctcaggtgatctgcctgcctcagcctcccaaagtgctgggattacaggcttgagccccaaggcgatttctgatccccaaagatgaggtgtaatttcacagcccctcctggcccatcgctgataaacccacagggcccgagagaatagaaggatgggaaaatgctggcttcatattgaatccctggaaaacactaaatcgtgactcagagagctagaaaaggatgaacacaaggagtcgacaaaagggcttctcagagcacaatacaattggttcattttcttttaaataaagttacaaattggagggtcacgggaagacaattcatttaatgtataaatatctcagctgagcacttggtgaagctcctcccctctgtgtggatacagttgcattttctatgatggtgcatttaactgggttcaaagctagttacacaactctggttgaacccaatgaatattgacttatgcagtggatttctaaactgtagagggggtgtgtgtaagagagagacagagatacgtaaagcatgcaggaaccttgtttttttttttgttttttttttaatgtctcctgcccccccatcttggatgatacaggaacctcattttaaaaggcacattcccagaccacactgatggaatgggccgggctgcttatctgcacttaacaggctccccaggtgattctgttcccgtggtctgaggaccacatcctgaaaaacactaaattaggagttgagggcgccctggaaggaggtttcttttcttttctttcttttttttttttttttttgagatagagtcttgctctgtctcccaggctggagtgaaatggtgcaatcgttgctccctgcaacctcctcctcctgggttctagcgattctcctgcctcagtctcccgagtagctgggattacaggcatgcgccaccacgcccagctaatttttgcatttttagtagagatggggtttcgccatgttggccaggctggtcttgaactcctgacctcagatgatctgcctgcctcagcctcccaaagtgctaggattacaggcatgagccactgcgcctggtaggaggtttctatcacagtcctccagggggttccgtcctagatcctgtgttgtttaaagaacaacagaacaaatataagtgtggacgtgtacattcatctccccccaccccaacccaaatgagcattttggatgaaaactcaggaggctgcttaatcaatcttcagatggtctcaagtggtgcaggtcagatggaatatgatggatgacaagagtcaagatttgaaatgatttgttcatgctggaatgttggactaaaaccaactagatgagatttcacagggatagatttaaagttctgcttttggttaaaacaacacaaaaatcaatacagcactataggaaggaggagagactgggcttaacagcaattcttgggaagaaattcaggggctgtttgtagaccacaagatcagtggggggcggggggaaccagggcgggtgcaagttcaggtcagtgccctgggaagtggaggacctaaggcatgacccctgctgcgctcagagctgatgaacaacctggacttgagtgactcactcaggccacatttaagagtgacattaaccaattagactttcatttggaggacagtgatggcatgggcaagggtctgaaaccttagtcccaagaaggacacctgcccacttggagagcatgaggtgagagggttatgaggaagccaggttcagctgtctgatggggcacggtgcagaactggaaacttcttccaggctgccctagaagacaaatgaagatccagggggtgagtggtttaaggaggcaggtgtcagctcagtagaagaaggaacattctataagttgggagttcacagtggaagaacagactgtgacatgggtggcctgaggatgttgggggaaagggtggaggatgtcgagagagtccacaattcctggaggtgtcaagagagacccaaggttggcaatgagtatgtgatctcagtagacctcagcgattcccaggcccacctgtgtcagaatcccctgggggctggtaaaagtgcaggtaacctaggccctccccagatctactgcatcagcatcccttgggctggctacagtctcccaacttttggagtcttaggactagaggacagtattttcctattgcccaaataaaatgtcctgtagaaccagcctgccagggaccctgaaccttcacctccccacccccagccccacctgccagaatgtgagatgtcatccacctactcaccgcagcccccaggaaagagttcctcagctcaagtcaaaaacctgctctccatagatgttcacagcagctgtattcagaattgccagaacttggaagcaacgaagatgtctttaacaggtgaatggataagctgtggtccatccagacaatgaaatattattcagcactgaaaaaaatgagttttcaagctggaataagtcatggaagaatcttaaatccatattactaagcgaaagaagccagtccgaaaatgctccacactgtatcgtttcaactctatgacattctgaaaaaggcaaaactaaggagaaagtgaaaaggtcaagggttaaggccaggtgcagtggctcacgcctgtaatcccagcactttgggaggccaaggcaggtggatcacctgaggtcaggagttcaagaccagcctggccaacatggtgaaacctcctttctactaataatacaaaaattagccaggcgtggtggcggacacctgtaatctcagctactcaggaggctgaggcaggagaatcacttaaacccaggagtcgggggttacagtgagctgagatagcgccattgcactccagcctgggcaacagagcgaaactctgtctcaaaaaaataaaaataaaaataaaggggttagaggggagggggtacttaatgggcagagcacagaggaattttagggcagtgaaactaccctgtatgatatggtaatggtggacacgtcattttttcatttttttttttaatttttgcagagatagggtctcactacgttgcgcaggctggtctccaactcctgggctcaagcgacctatccgcctcagcctcccaaagtgttgggatcacaggcgtgagccaccacacccagccaacacatgtcattatccatatgtccaaacctatagaatgtgcaacgctgagaatgaaccctagtggaagctgtgggctctgggtgatgatgtgtgcatctgggctcatcagttgtaatggatgtaccactctggtgcagggttttagggtggagtaagaggctgtgcgtgtgtggggcagcagatatatgggaactctctactgtccacttaattttgctgtgaacctaaaactgctctaaaaacaagcttttttttttttttggagacagagtctagctctgtcacccaggagggagtgcagtgccatgatcttggctcactgcaacctccacctcctgggttcaagcaattctatgcctcaactcaacctcctgagtagctgggattacaggcatgagccaccgcacccaaccctaagcttattttttaatataagcaaacattctcctctgtgtatcacctctaacctctgtttgggatcttgcttatagtgctgcggtgggcgttggtttctatggaaacagcgagaccaacgatggggcgtaccagctgatgtactccttggacgatgccaaccacaccttctctgggatcgatgctctggtaaggctcccgggcagctggccgggtacaggcacagcccacaaggtcagcgtggtcagagcaagggcccccgtcagatcccagctagctcagctgcacacggaggggctgtgtgacgcctgagggctggacccccgcctgcgctgcagttgcctctgctggggcaaatgggcaattgtgcgttccaagcctgcaggggtggcagggatgggggtgaggactaaaggaggcagctgtgggatcaaaccccattttccaacaagccgaacactttctgatttgtcaaaggagaccttgaacatggaaaatcagccccactgcattttttgttttcattttaagtgctgcatatggagtattgcaaggtccaggagatgccaagaggaaaaaactctcttcagagacaactgagggctgggcgtggtggctcactcctgtcttcccagcactttgagggaggccaaggcatgtggagctcaggagtttgagaccagcctgggcaacatggcaaaaccctgtctgtaccaaaaatacaaaaattagccagttgtggtgtggttccagctacttgggaggctgaggcagggagatcacttgagcctgggaagcggaggttgcagtgagccaagatcacgccaccacactccagcctgggcaacagaatgagactccatctcaaaaattaaagaaaaaaaaaaaattgaagagccccgtgatgtaaggtagtggagacctgccccagctcctcggagctctggcttccaggcagtgactccaggtgggggctcacagtgaaggatgctctggcctggccagaggaggtgtcagactcttaggggaaggggaaggctactctgccaagccagggctggattttgtggcagacgctgcctgatacacacgagccttttgctggggctgccacccctctgctggggacctggcccagggaggagcacgacaagggtggacatctgaggacttggttccctgaaaactgcctctgccttttctaccccagctgcctggaattggagttttcccacagtttgaccttggcccccacacacgtcattctcactctaagcaccagaccttttcagctgcttatccgagcagcctctgccacaaaatccagccccaacaggagaatttggccattgccccggcatcctccagaagaggattggaccccatttgcccccctcctgctcccttaagctcctctaaggctttaatccctcagtcaacaaggggggtcgggggtgtcaccttaaagagacagctgtgctgctcctccgtgcccaagtcaattgtgggaggaggccctggcctccagaaaggggctgagggtggctacaaaaccaggggccctggtcctttgcagagttcattccaccgcccgtgtccactgggacccatccccttagctgagcgctgagtcccagtgcggagatgctagtctggaacagccttgcgcggtgagctggggcggctgggttggaggagctgagggacagccagctcaggcctgggaggcagaggtgtggcctgcctggggagaactctccctctgggcacccacccttgccccaggccctggtggggaagggccccatggtcactgccctctaggctctctctgcccctccctgccatcctgctgcctgcctcctcttcacccaccagcaccaggatcactggaggaggaacctagccccgagaggaaaatcccctgccctgcccaggaaggcaccagggccatgaccttcacgggtttagagaaactcccagaactcccttatgggaaaacatcaagtcctagaagtccctatcccacaggacgagagctgccagggaggggagctggaacgggcccccaggctggggcctcccaccccatggcctgatggtgctccagggccaggtttggacatttcacagcaggttccactctctgaaatccctgctccagggccaggtttggacatttcacagcaggccccactctctgaaatcccctgtgttcccaaagagaagggttctgtatccctggagatcagcccctcgtcctctccgttgttaccgagaagtgaggtcaggagtcccagggcttcacactggtccagccagcccatagctgcctccagcctgtgggtggtcacctccccctctggcgtgaacccctagggcccaggtgtagctgctgccttgcctccaggtggaaaggtggcactgggtccttactaggacctgtgaggctggtttgggcctcagagtggacacccagcacaccagtcctcagggctccaggggaggcagcagatcttagaagacttcccagatccaaggggagaagtccggatatcagataaatgactagtgagataatgtcagtgaaagtgctggtagactgtaaagtacactcagctgtatgactgtgattatgagtgctattaattactgtaatcaccttggggtcagcgggaggctgggatccaggacgctgtgggcggcagaggcagatgggggactcgtcgacaggtcaggcaggacctggatctgggccttgccagaggccagatcatgcagctgagtggccaacaagaagccctctagggatgcacccacagagtggggtgggccctgctccaagtcctcctttcctggactggaagccccatacctatgcacgtccaactagagggacacctgtgccttggtgggtaggggcggtggttcagggatcaggcggtcctgggagggctgcacgccccagtctaggggagtagagaggagtcgttttgggataccaaaacttcctgtacctggtagccagcacggcccctccaggctctctcatgtgagtctgcagcaggctgatgggcagccctcagatgtagaaactgaggcacagggaggttgcattgctgacccgaggttgaaaatgtgtatgtttcagagcagaaaccagaacccaggcctcctggtcttagccccttacctccactgacctggcccatccacacttccagataagctcactgagcgctggagagtcctccctcccagaagttttcatacttgagcttgcatcagaatcacctggaagggttggtaaacactgattgcagggccctgcccccagaggttccgcttcagcggtcctggggcagggctgagagcttttgcttttgtgagtgagttcccagggggtgcatcttacgcccctagtcccgggaccacacttgagaactgctctttcctctagaccgtggtctccgccacctgtagctcgtccctaagtctgcccagcctggaaaactgacctgtccctcctgttctcagagctttccgtgagagagagcctgattccatctctgggtcatcccacctgtccctgcggggagtattatgtcctgaaactttaaggaattggggatggtatagagaagtggggagttgtaagtaggtcactgctgtcattcttattttttaaaattttaggatcttttgagcctaggagttcaagaacagcctgggcagcatagcgagaccccatctcaaaaaaacaattttttagttttgtttcctgtgggaaaatatcaggaagaaagagaaggcatgacaaatacaaatactgccttctttttttttccccctaaggaggagtttaagaaatagagaagttaactgtgagagagtagaactgtgagggagaaaacaagtggcctcacagaaaaagtttacagataattttttaacagccctttactctgaagtttgtttgatttatagaaatatagaaatatagaaatgtcacctattactgggtttgttcagaatggcactattctttgatgatagtgccatttgtataaatgtttccaaagtggttgtacatttatcttattaaattgaacagccaagtgtactagcatgacatttagttactgaatgtacttttacatggtttggggtcttttcccctgtgcttcgggctgtcgaatctgcacatggtagagtgtctccgtactctggtatctcttagtccttaaccaactcgtaagaaccaagcataagccagaaaacggaacaagccgctgacactgaaaaaataaaacaaaatgaaacaaagagagccattctcttttctggaactaggaactcccagcgtagcgcagatgtaaaaggccacacagctgatgtgaagtccccataacacagagaacaccgttggcctccgagagtggaatctaatcggccttgctgatctcactgtgggaagtttctgcctcttcttctgtgtcgtttttatctcccagacccgtgggagctgaaggctgccgagtgtggattagtgcacactgccccactcccggcccgttgtgcttcttggtttagtgtgacagtttcagaacaacaaagccctttctccgctcgctgccagcaagggcgtgcttggggctgccaagctgcaccccggggttctgcaggcaccctgggtctgggctgtgggaaagtcccgctaaccagtacgagccctgcctgtgctcttcaaaagccagctagggttgaccacttggaccattagaaatggatgcacatggccgggcgtggtggctcatgcttgcaatcccagcattttgggaggccgaggtgggtggatcacttgaggccaggagctcgagagaccagcctggccaacatggtgaaactgtctccactaaaaatacaaaaattagccgggcatggtggtgcacacctgtagtcctagctacttgggagggaggctgaggcaggagaatcacttgaacccgggaggcggaggttgcagtgagccaagattgcaccactgcactccagcctgggtgacacagagcgagactccatctcaaaaaaaaaaaaaaaacaaaaaagagaaagaaagaaatggatgaacgggctactctggcacactgcctagagggtagccctgctctgcaaggagcagtacctttaaatataaataaataaataatgtttttaactggatggccagccgtcaactttctatttctgtcttgcattggcagatgtttccttcagggtccactcaaccccaggcccttagggctcagccaagggacaggagcctgtctgcccacccagcaggacacacatccaggggaggatgtgaatacaaggagaaggcgccggtttcctcctcctgcctcatgtccaggctcctcagagacaggatcgcagctgtttttgtttttgcaaagtcccattgtcctgccttcactcagcgttcaggacccggtgtgctgcggctagtgccacaacaaagcttttctcttatagaacaattagaaatcctattgtggggatacaaggtcaaggtagcaacatagagtctgtttctctaaaagagaatttgtaagccaaagtgctgaaagttttaagagaatcttcaaagaataatggattattttgttggtttctccatctgggtgtctctgtatatagtaaggtatagtaatgaatgcatacgtttattccagccctttacagcaggggccacgtggtgggcacacaggatagcctccttagtagagagcaacagaggctccagagggcagggatgtgcccacactcccagcgccagaggctagacctggcctcagcctgcaacacataatggtgtgctcctttggcgccagcattctctctctcggagcccagatcctgtttaaggccaggtcagggactgccccctggtttgagggacatgaggactgggtgggtagtggcggcctctgtcttcagtccttcctccaggggcacaggctcgagatcttcaggcctggggcagcatggtgtgttcattcatgcctaagcaggccaggccagctttttttttttttttttcgacacagagtatcactcttgtcgcccaggctggagtgcaatggtgcgatcttgactcattgcagactccgcctcccgggtccaagtgattgtcctgcctcaacctcccaagtagctaggactataggtacatgccaccacacctggctaatttttatatatttttttgtagagacagggtctcactgtgttgcccaggctggtctcaaactcctgggttcaagcaatccgcctgcctcagcctcccgaagtgctgggatgacaggcatgagcgtaattatcgcacctggccaggccaccttctgctgcctgcaaagacctcttccgggatgagaatcagaagctctacctccatggcttttgccccctgctcctccctaggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtgaaggaccggtgggaggcagagggaggggcagcagcggctacatcagctttgtttatccaaacctgcatgttgagctccaggtggagaagggccactggaaagtattttttttttgttttgtttttttaagacagagtcttgctctgttgcccaggctggagtgaagtggcacgatctcagctcactacaatctctacctccggggttcaagagattctcttgcctcagcctccctcccaagtagctgggactacaggtgtgtgccgccacgccagactaatttttgtatttttagtagagacagagtttcaccatgttggccaggctagtctctcgagctcctggcctcaagtgatccactggcctcagcctcccaaagtgctgggattacaggcgtgagccaccatgcccagcccaccagaaagtcttgataagccattggccaaaatcaggagaacatgggggcttacaggggccacgtggtgagcatgcaggatagcctccttaatagataggcagcagaggctacagaggacagggatgtgctcacactccccgcgccaaaggctggacctggcctcagcctcccgcacacggtggggtgcttctctgggactagcattcttcgtggctggtgcagggtggaaacgccacatgcttcataggttcctcgcctgccagagttcatgggacaggatttcttgtatccacagacacagccacagggttatggggggttgaggagatgagcacccggctaagggtgctaagaagttgccatcaggggaggctctgacctacaagtcattgtgctcccagggcctgggcctaagcgtggaggaggcacaagggaggaatgaggctgtgtccccagactcactttttttttctttctttttaagacagtatctcactctgtcacccaggctggagtgcagtggtgtgatcatggctcattgtagccttgaactcctgggctcaagtgatcctcccgcctcagcctcctgagtagctgggactacaggcatacaaccacacctggctagtttaaaaaaatttttttttgcagctgggactggtggctcacacctataatcccagcactttgggaggccaaggcaggcagatcgcctgaggtcgggagtccgagaccagcctgaccaacatggagaaaccctgtctctactaaaaaatacaaaattagctgggcgtggtggcgcatgcctgtaatcccagctacttgggaggctgaggcagcagaattgcttgaacccaggaggtggaggttgcagtgagccaagatcatgccatcacactccagcctcagcaacaagagggaaactccatctcaaaaaaaaaaaaaaaatttttttttagaaataggggtcttgctttgttgcccaggctggtctcaaactcctggcctcaagcaatcctcccacctcagcctcccaaagtccaaggattacagacatgagccaccatgcccagaccagcctcacttatgtagaacctgagtgatggggactgaggggcaccaccctcacttaggtgtacaaactcatgcccgtgtcatctgacctctggggctttgtttacatctcccctgcctccccatttgccaaatcccagcctagccagaggcactggacacaatcggcggagcagggacctgctgcccctctccaggtgcagggtccagcgaagtttgctccgtggaaagcacaggaaggaggcagcagccccagcctttggagggctcccggctgaatgatggcctgggcttgtgctcccagggcccgggcctagcatggaggaggcacgtggggaggggaagcatgagtcaggaggagcgagtgtcagttctttggatccctccccgcaccctccatttgttggctcctcttcaagccattgatgaacgtcagagcctttagctcagggttgcacaacttacttctgttttctggatttgtgtccccttgtgtcataaagccccactccaggaggtcactgctggactgagtccaggggcctctccccttcccaaaaataggaggtggcaggtccctgagcagagggagctcatgaagtccccagctctgggggtcctccccacaccttgcctccccagcccgtccagtccctgcatctccgccatgtcctggatgctctggattgaagggaccttggccccactccccagcagatggatgctcatgggcaaaagagcctccctcccaagggacagaaggaaactgccagctctaaggactgtctgtgacctcctgtggccccaaaacaggggtgtctgatgattctcctgatgcatgggccattcattgcctgagccttcgaaatcttatgtcaggcaggggcaggacccattttaacgtcactcttctctgagcacacctagcagaggactgtgtatgtttaagggcctcatgtgggcattttgttaatgacactgatggaattaagtcagaatttacatatcaaaggcggcttattgttaaggcgatggtattaaaatagtggaaggatggtgtcaactgcacatcagctatttcagcgtgggtgattgacaggaccccctgtgagtccatccccaactccccactgcttattcgggttgaggcagaagaggtttggctcatgctgtaatcccagcactttgggaggctgaggtgggtggatcacctgaggccagtaattcgagaccagcctgggcaacatggagaaacctcatctctactaaaaatacaaaaattagctggacgtggtggcgcacgcctgtagtcccagctacttgggaggctgaggcaggaaaattgcttgaacccaggaagcggaggctgcagtgagccgagattgcgccactgcactccagtcagggcaatagagtgagactctgtctcaaaaaaaaaaaaaaagcagaggtctagtccaaggttggcacctatggcgcctgaacatcagtgatattctaccccttctcctgtctttgcttccatctgtggcttctcctctcacctgagctgctctgcaaaaaaagccctcccctgaagggcccctgtctttgcttttgggatagtccttgagcataaccatgcagcaaagcagatatttcctagcatttttatacaaggcggggcgaagtattggaggagataaaaagccaaggggctcctctctttgagaggctacggttgagggaagagggagccggggtgggagtggctctggcaggcagagccgagttcttggttaggaatacatcccccagtcctcgcccagctcctctgggaaaacacatccgcctagaggagatgtttccaggaacccctgacaacatgaggcgtggaggcagggaaaatacattgaatcacagccacagagagtgggttagaagcacccctaactggatttcctgctgctctgcagagcggaggcgagtggtgagaagaaatctttaagtttgaaacatgaactgggtatttcgagaggtgccctgtagctggctgtgtcccttgcaggaagcttgatgtagacaatgtggaatttctgggccaggctctccccaccaggggccttggctttctaatctgtactaatctgtagaatgggatccagctcacacctatgatcccagcactttgggaggctgaggcaggaggatctcttgagtccaggagtttgagaccagcctggacaacatagacagacccggtatttataatacgtgtgtgtgtgtgtgtgtgtgtgtgtgtgtgtgtgcgtgtaaaaataagaatgtgatccaaacactagatggtttgcgaggttccttccagctctgagctaagtctaaggaaactggcttcttggtggcagcaggctctgcccactccccaaagcccccggctccattccggggaaccccagagacctagtgtgtgctgccccctgctcgtgcagagacaaggactttgattagtccccttcttttggcagtaagcctcaattcggggagtcagaaagaacctcccttggctgccaggcctccagcttgctccctcccctctctccctcggagcctctttgccactttctgccagctccagggcactccctgcccacgctccaaactccgtcttcccctttatgatgtcagtgaagcagaaaaccattgctggagaggagaggtcagcgactttacttggctcttgcagcaagagaaataatgatccaaatacttccctctttggggacggggaagcccctgtctctgtgcccgcccctcctctgtccactctcccgctggtgcccagcacagggtaaagggcatggctgccaggggagaccactgggccttgtgaggaccaccttggggacctgtgtggaagggaaaggaacgagggcactttgtttggggtcttctcagtgtccgttggcttaagatactttgattcttcagcctgttctctggagaagcaggagggcagggcctttgaagtccttggctgccttgccccatcaacctttatatttagcaagcacttaatccttcctctggccctgtgagatgaggggttccagctccctctacagatatggaaaccaaggtctcaaggggtgaagtggcttaccaaggtctcccagctggggtgtgactgcctttccccatcagtccagccctggggacaaaaaggccagaggaatgaagggcttggaggaggctggaggtctgcagggctgtaggtaccctgacctggactcccgggttccacactgagccctctgatggtcagaaacgagcccactcacctgggtatccctggtgccaagctcagtgcctggcacaaatgttgtttaaaaatgaacctgaagttttttgttgttgttgtttttgagatggagtctcactctgtggcccaggctggagtgcaatggcgccatctcagctcactgcaacctctgcctcctggtttcaagtgattctcctgcatcagcctcccgagtagctgggactacaggtgcccgccaccacacctggctaatttttgtatattttgtagagatgaggtttcaccacgttggccaggctggtctcgaactcctggcctcaagtgatctgcccgtcttggcctcccaaagtgctgggattacaggcgtgagccactgcgcctgtcctgaacctaaaagtcttaagttatggatcccatccagcaagggggcaagatgggaggccttggggagccaggctgagtgtttgtcaaagaggcaggcaccttaggggctgtgttagatctgtggctataaacatcaggccttggctggtctgatgctgtctgagagttctagaagcaaagggaagcagggtcctaggcgatgcctgctgggaggccgcagaaagacacttcagagctgtgctgtccagggtggtagccccagccatgtgtggctattgaaattaattaaaattaagtaaagtttaaaatgtatttcttcagttgcacaagccatatttcaagttctcggtagccacctgtgggtagtggcaaagaagagagtggacagcagggatttagaacagctcctccactggggaaagttctagtgcacagtgctggttttgacactcagcctagaggtgaaggcagggggtgtgaattgacagctttgtccaggcagcagtgggggtgcagctcccgaggcttcagcccacgcatgctgggtgcttgctggctctgggcagcatgtccatagtagagggtccagtgtgtcccagggctgccgtgcaggcctctcacgtggccagcaggtcagaagttccaccctgctgctcctgaccatccctgcccctctacccaggtggctctcctacctcctgctctttatcctggacctggtcatctgcctcattgcctgcctgggactggccaagcgctccaagtgtctcctggcctcgtgagtatccctacccgtggacctgggacaaagagctgggcaggatgccatcatcagagagagacgagggcctggccagctccagagtgtggggaaaatagccaggctgcctgaggccaccttctgccccgtcctcagcactcagcagaggagacagacagcagccaccaactcaccatctggtcaccaaacgagcaagcattaggctttcctccttctctgggcctgactctgttgagcagctaagaaacatgggtccgtgcatgaaagcctctggccgtcttagccaacactgcccccttagcctgtgctctcacgcctgggtctctttagcctcaaggacctgggctccatggtcctttcctagtagtgagcagggcccacgtcagggcagggactgaggctgcctttggatccattgcaagggtctgggggcagggtgggtggggtgatggctgagaggaaggggaccccgcctgccaacgttgtcgcctgcctctctcctaggatgctgtgctgtggggcactgagcctgctcctcagttgggcatccctggccgctgatggctctgcggcagtggtgagttgggggagggagtgggtggtgggtggtggttggtctgccaggacactctggtgtgtctccaagcagggccagcttccggtcccagctcctaacctagaatcccagaatctcagaaccaaagggacttgcgtcatctgaaccggcccctctcgttacagatggggaaacaggcccagagaaaggaaggggactgcccagggtcagagccaggataagacactcatgcttcatacccagagagaagcccccggctgcccaggcatgcttaggcttacacgtgcttaggcttaggcgtgcctgggtgaccagggcgcttctctctgggtgtgaagaactgaccgggtctcctgagaatgggtaggggtccaagcctcagactggggaatccctcccgcatcagaagctgctgctttgccagctccccaggccctgggactgtagaatgtggtgtctgacttgccttccatcccaatgtcccaggactcccgcggtctgaagcacacatgctgtatgtttctggatgtgatgtctcaaaatggcttaaaaaaaaaaagttgggggcttcctatgcgggtccacatgatctttaaaggacctaacactggcgctaagctgtgtgcatgaggctgttcattcactcagctgacattgtttgctgggtggcactcgatggtacaagttgcctggggttgcggaagccaagaggacgtgatgtttgctgttgacaaagttccagcctttggaagcaagactcataggcagatcactgcaaccccaggctttgatacagtggaggtgcagtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgcatctgttctgccatagtgacctgaggcttgataggataagatgggggtggcttgtacaagaagctccctaaccacactcacacctcgtccagtgacttgggggctggccactagctctgggcgtggacacaatgccctcagggactctggcactgcctgacttagcaccttaggcagaggcttgtgcagaagggagaagagggggcattttctgtctttgcctcctgccaccccagtgcagtgaccacggaccaaggaatggtcgagaaaaggcccaagtcatgtttgaaagcatgcaggagctgggacggctgtaaacagtgccactgctggccagggtgatgcaggcagctgcctggcctccagcctctcctctggggccagggccacgcacagggaagctgcagggagcacacggcgaactcctccagggccccatcccgctttctgggcagcctctgccttctggaggcagcggtggcttccagcttgccgctgtgagctgccctgtggtggccgcccctcccagtgggggctcctccctctcaccaggcttcagtgttcacgaaaaccagaggccatttaatctcccagctgggcgccctggaatgcggggagctggggagaaaggccatttccctaattcctctagtcaggcccctgagtgcgagatggggagcaggcggtggagctgaatgggcttttgacgggctggagatgctgctgcattttaataggaagccgggtgaggaggagccaggagggcggggagggcggccggctgtcccggggttgttgtggagagcttttgtgtggcctcccaatgccaccctgctctctgaggcctgttttgacagccatggggccagaggattgacaaggcctcccttccccacccccgacccctacccctccctgtccctagaaaggactccatgaggacagagcactgccctggagatctgctctgggtgaggcagggagaggagggagcagcggagctccaagcttccaggccctggggccacccctcgtggtcagcactgcgagtcaggaggtgtctggggtgaggggctagagcaggcagagaggctgggaagccctggaagaaggaaggggaaggaaatgggttcagctgtgagggaggaggcaatggctgtcacaagtgctttggccaccgagcctggggacagagaacttcaggggattcctccagctaaggggcagccaggcctgcccctgagtcagagggtgggagtgtggcctctgcagccaccctgtctgggcccacatcctcccttcaccccttcccagcagtggaaacccaggaaagttcctgaggttttctgtgcctcagcttcctcctaggtgaacacagagaataacaggacttacctcaaagggctgttgctagggaaagatgagtgggttcatcctgggaggcacacagaaaatgtccaataaacagtggccaccactggcttcctgtgcattcatcgtcatcatgctagggtcacgggggtcccttcagacccacacctccattctcaggagctgcctgcaggctcagccatcacctgggctggttactgggcagcctctcccacctgccccaactatgctcagtgacctccttcctgtcccctctcctgccatccctatcaccatggcatgagtaatgcacacgtgtattagtccattttcacactgctgataaagacatacccaagactgggcaatttacaaaagaaagaggtttgattggactcacagttccacatggctgaggaagccccacaatcatggtggaaggcaaggaggagcaagtcacgtcttacatggatggcagcaggcaaagagagaggacgtatgcagggaaactcctgtttttaaaaccatcagatctgccaggtgtggtggctcacacctgtaatcccagcactttgggaggctgaggcagggggatcacctgaggtcaggagttcaaaaccagcctgaccaacatgccagaaccccatctctagtaaaaatacaaaattagccaggcatagtggtgcattcctataatctcagctactcgggagactgaggcaggaggattgcttgaacccgggaggtggacgttgcagtgagccaagatcacgccactgcactccagcctgggcgacagagtgagactctgtctcaaaaaaaaaaaaaaaaaaaaatcaggtcttgtgagacttattcattatcaaaagaacagcgtgagaaagacttgcccccgtgactcagttacctcccaccaggtccctcccataacatgtgggaattcaagatgagatctgggtggaccatttcgacatgcacacacacaagggcatcacacacatacatgcacacgcacacaggtgcttgtcttcattaataggagagttgactcctcactgagtcccacaccccaaaccatcctatgcacctatcccaggagatggaggctccagggtggccaaggggtgtgaagagcaggcctggcctgggaggggaaggaggagagaggcaggaggaagaccatgtcactgtggagccttggactggagcctcctgtccctctcctttcttggttcccaaacttcttgggggtgacccaaactgagatggtggcctcgctctttatttccccaaggcttccccatcctccacttgggcctggctgcactctctgtcactccagccagggggtgggggcacaccaccaggcctgctggcgccgcagctctgataggtaataataggccaggttgatgtattatgaatgctggtggtttgtgtataaagcatttctcccagggtcttaagtgcgtgcgtgcgtgcgtgcatgcgtgtgtgtgtgtgtgcgcgtgcgtgcatgtggggctctcgggaagctctgtatctggaggggtgtgttattccgcaccctcgctatacacacattttctagaccgtaagtgctgtgatgcactaacctctaggtgctagaaccctgcacggcactgagtaagtactccataaatgtctatcaacttagcaagttagtgagtgatgctctattgtggacccctgaggcagtggctcctgaaggaggacggggccaccggcagagcagggcactcagaggggtcccctgcccggggagcatgtgccagaggagggggacatccctaaggaacaggccagaggacctgagctctccctggctgctctggaaggcggaggccccccagtttatccagtccctagagcaccccaggccagatctggggtgcgcctggcttggaggccatgtccttgctgccgcctctcctggggcctgcgtctgctcccaccctgccgcatgggccttagcaatcacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacaggtaactacacactctcaggctgctgctgtggatgcataggtggccggactctgtgcccctacttacctctttcagccctgtagccatccaacccctcctcaaccctgaacttcaagtccagctcatgctctaggccatttcctagaaagtgcctcccttgggagctcagggacggggagggaggtctggcttggccaccaaggatgatagagatctcatctggtcatttgtgagctgcctaacgttatgccgttgccctgcagaggtgactcgctactacctgtattgcagccagagtggaagcagccccttccagcaggtatggccccccgaggcctgccctcaccctgcccacagccgctcccccttgaccctaagcctcaccactgaccaagatggcggaggtggcagggccttgcttgcctcactgtggtcctctccttagctgcttctgtgaggggggcgtgcttttggtcgtgggttctagattggtggttaacacatatgcagctcaatgcgggagctagttcccatgcagatgctgtccaggagctctggggtggggccgagattctgtactactcacaagctcccaggtgaggccagggctgctggtccaaagaccacatctgagctgcaagcagggagaagactgtgcagctctcaagaagccagaggagtagggggagacttcctgcaagtggaggggcctgtgcagctgcagccaggtgggggggtgggaggggcaggagcataggcccctcagccactgtggggctcctgggagacggagcctcactgtggggctcctgggagacggagcctcactgtggggctgtgtctttcctggctcagaccctgaccaccttccagcgcgcacttaccaccatgcagatccaggtcgcggggctgctgcagtttgccgtgcccctcttctccactgcagaggtaaggcagctgtgcaggaagaggggagccccagatgaaccctgacagccctttcccctgccccggccccagggccaggctgtgcacagcttgctgctggctctctgttctcccgcccccgtgactcggctccctcccttggctctagaggcccctgagcacagctgctgtggtggttttctccgccagctctcctccacagcccctcggcctctctcgctctcttcccgcttcaggaagacctgcttgcaatccagctcctgctgaactcctcagagtccagccttcaccagctgaccgccatggtggactgccgagggctgcacaaggtgcatggggaccctggggtcacgtggagagtgtgagggcacccagcaggccacaccttccagagaaaagccggtagaggccgaggggagcgatggcctgggtccccttccggcccaggaatggaactgaagccagataatgggaagggagggggtgcctggcttctccaggggctgagacagggagactcagtacaagggaccaggggttcgggatgggagggttggatgcggttggctctgggtcactgggggaccctgaacaatgcaagggaggctgttccccattgtccagactcctagccatttcctcaacacatctgtctccctgggttgcaagtggatgtcccaatcccattgccagagtcttctttccaggaacttggaatatcagacagacacaatgatgcagggaacacatggggagcacgtgagagccccccacccaaaagcagtgagccagtgtatggcgacagctttcacatcccagatggatttagtgcagacagtctttgtcatcatcacagctgtcagctccatgcttggccctgttctgtgcattttatatccagtatgtcattcagttctcacagttatactgtgaaccacacgttatttcctaggaaattgacttgcttgtgcgtgtgtatggatagatccatagatacagctatgtgtgtgtgcacgtgcgtgtgtctgtgtgtgtgtgcgtgtgtgtgcacttgtggtgtatatgtctgtgcgtgtgtggtgtgtttctgcggttgtgtgggtgcacatatgtgatgtgtgtatgtatgtgtgtggtatgtgcatgcttgtgcgcatgtgtgctgtgcatgcgtgtgtgtggtgcatgtgtatgtgcctgtatgtgtgtgtggggtgtgtggtgtgtgcgtgtgtgtggtgtgtgcatgtctgtgatgtgtgtggtgtgtgtgcatgtgtgttgtgtgcacatgtgtgcacatgtatgtggtgtgtgtggtgcatgtgtgtgtgcatgtggggggtgcatgtgtgtggggggtgtgtgtgcgtgtatttataaagtggcttactgaagagtcccgagttggcacatcaggggcttgggtttagatcctggtagtctgacctcagagctaagaacatggcagtcacccctgtctcctctcttcttccccttctacatctaatccccagcaagtcttggcagctctcctctcagctgtaccctgaatccatccatttctctttctctccatggcttccaccacgatccggtcctgcccctccagcagacagtggcctcttcccactttctcttgccccctcaccacccatgagctttcacacatgcaaccagagcagtccttttgcagactaggttggatcacatcccttccactcccacaccctccaatgtctttctgactccttttaaaagtccgtactcctctcccgcattgcaaggcccagcacgacccagcccctgctggcctatgttctctctctttcctgaacaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagtaagtgctcagcaaatgtttccagcgtgaacccaagaagccccattgtgttaggctccagagtgtggacctttaatggtgctgcaaggcgctcgggatggggagcagccaggagaccccaggtccaggctcgggggagagggacttccagaggagagctcggcccgcaggctttgcccccgctccttcactagctgcatgtccctcctcttcctccaggattatctggacgctcttgctggcatctgctacgacggcctccagggcttgctgtaccttggcctcttctccttcctggccgccctcgccttctccaccatgatctgtgcagggccaagggcctggaagcacttcaccaccaggtgggctgcctagtaaggaggggagcctcccacagcctggagttctgggagagcagcagacaggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctgggggaagaaaccactgatgtcagcagcctctgccacaagctggtgggacaggtctcaggcccaaaaagctgcatttctccaggccatgctgctcccagcctccgttgcccatcagccacttgtccccaggcttcccaaggtgctcttctccatatctgcccactgcaccccctccactctatctgtggtttggttccatcccccacctcccatgtgctcacccatgggaccctcctgtagaaatctacacacacccccactcccacaccatcccctcctgagctctcctctcatccccgcaggaaccaagccatgctctttggtaggaacccacgctacgagaacgtgccactaatcgggagagcctcccctccgcctacggtaattggggctctggcccttccttgttggggtaatacataaagacaaaacctcctgccaacccagtgaatcctgtccacaaaggcagaaaagaatgaaactgttctgttattgaatatgcactaaaccagaccgtcgtgggtatcccaggcagtccgctaaggagattgcaaagatgcaagaaatctcactccttcccctagccaggcaggaacaagacacagcccactgcatacctgtcatccagcaagaggacttgacggcactgtttgtcacagtagtccaccttaatccacttgctaattggggtggccatcctggttaagtaattgcctttatttatttatttatttattttttgaggcagaatctcactctattgcccaggctggggtgcagtggcgcaatatcggcttactgcaacccaggtttcaagcaattatcctgcctcagcctcccaagtaggtgggactacaggtgcgtgccacaacgccaggctaatttttgtatttttagtagagatggggtttctccatgatggccaggctggtctcaaacttctgacctcaggtgatccacccgcctcggcctcccaaagtgctgggattacaggcatgagccaccgcgcccggccagctaattgcctttatccagaggaaaaataaaactcctatttccgtgacaatcagatagctacaacttggagccaggcccctaagtgaactgtcactgagaaggagatgaggtgctgtcttcctgatgtttgtacttccaagagatggctcccagacctgaaaaaaccatacctggattgtaacactggcaagggccatattcagcctttaagaaggtttgcagacatctcaaaagacagaaattatttacaatgataagttttctaaaggaaatactgcaagaagagagggggtctctttccctttttgctccagagaaaattaaggaattttttttctttttagatttctgtttaccttaatccttggtctcttttgggctggacggtgggttggctgtggtggcgggtctgggagggctgaacccaaacacagccttcctcaatccgtctcagctccccatgtccctaggactgtgcccaagtagggccagtgcctcttgtccaccccaccacctccagccagagtacctgagatacagcctcaggggagtagctcagggtgggcaggttgagaaggaaagactatgctgtctcatcccagagaagtatccaaaggacacagaaatactggctgagacaaagaaagctgtaaacagacagtgaagtgaccgccaaggttcagggacacggactccagtgccaaaggcctgggttcaaatcccagctcatggcttatggcctctgtgactttggacaagcactttgctgctctgtgcctcagtttccccatctatagaatgagtatgggaatactagcacattcctcctcggtggtgtgtgcaatgggcaaattgattgttatcagagcgtacgtgcgaagcatccagtgagtgccgtaggacagtgagctgttatttgtgactttcttccaccccaccttctccacagagctgtggcatttatcaattttattttattttttattttttatttttttttgagacggagtctcactcttctgcccaggctggagtgcagtgatgtcatctcagctcactacaacctccacctcccaggttcaagtgattctcctgcctcagcctccctactagctgggattacaggcatgcaccaccacacctggctaatttttgtatttttagcagagacagggctggctggtcttgaactcctgacctcaggtgatccacccatcttggcctcccaaagtgctgggattacaggcatgagccaccgtgcccggccagagctgtggcatttataagaaaggacaaggggaatgaaaggccagaagtctgccatggggtgggcagaagggtcctggagccaggcatctcccttcattgggcctggcgaggcatttcagtgccccgacccagatagtttggaaggggacatccaacaggaaagcagaagcactggggcccaaatacctgggaccagcgtgatagacctgggccctgaggacccaggaagtgcacgcacaggcacccagggagtcagcttcccggtcatggcgcttggtgaaaatcatagtgtcagacccgagaaaagagcaagtggaacccagtccctgtcttcaggaagttccagtctatagaaggggcactcaagaaggctgcctgtagaaagtgctacaaggtactttgggaccagaaagaaggagccatctttgctgctgctctaggggattccagaaggttctatttaataggtggcgtttgagccacagtgtagagcaggggctcacccaggggcagttttcccccctggggacatttggcaatgtctggaggcattttcattaccacgcttggaggctggggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttttgcctggagcacctcacctgctgtcccatcccacagctttacaaacacaagccccagcctcatgtcgttctttcttcctggggtccccgggagtgggctggttgaacctgtattcaaagtcagcaccatttattatttatgtttatttttttgagacagagtatcactctgtgacctaggctggagtacgtggtgcaatctcagctcactgcatcctccacctcctgagttcaagcaattctcatgcctcagcctcccaagtacttgggactataggcacgtgccatcacacccagctaatctttgcattttcagtagagacggggtttcgccatgcaggccaggctagtctctaactcctggcctcaagtgatgcacctgccttggcctcccaaagtgctggggttacaggcatgagccaccacgcccagcctaaaagtcagcaccttttaaatgccagcctagcttctctcactaatcagaagcctcccgggttcctttttccaaccaccagctgccgtggccccaggaatgcagattgactttaatattaatctaagcacaacgtaattaggggaaatctgctgtgaaaaaagaattactctatgcactgtgatgccaaataaaaatgattttcagattcccttctgtttgaaagatccaggccactcatcctgccgttagcagagataatcagcaactgaccttatttgcaaggctcaaggacagaaaacccttcctccctagatttaagacctgcccagaaacacttattgctttggccaagttgactgcccagtcccacctagcccagcctgccctgggaagacccttccacctccatgcccggtaagggacctagagagacatctaatgatgccgcagaccaaggaaccccacagcatggagggtgtgggtgtctgccccagtaaagacagcacagctggctgcgccccaccctccccggggcgcctgctctaaacactccttagcaccgagcaagttcgagaggtggataaactcctccctctgccgagcaccctctctgggacagtcaggggacctcactgggtgggtgatgtcacgcctggtgatcgggatatacagcctgtcccttgctggaaatgtttcttcccccagctctgccttcaaggaataatctctcctgtccttttaggcactgtttcttggacttgatgaacaaaaatgacccagggcagttaaagatactgacgttgagacttctcttcagacttacagaaacagaatatcttggggaaggagcctgggagattctaagtttaacaaacttattatcattcaagttgggaaatattgctttaagaaggagggtcttggccagcaccatgcctcatgcctgtaatcccagcactttgggaggccaaggcaggtggatcacttgaggccaggagctcgagaccagcctggtcaacatggtgaaaccccgtctctactaaaaatacaaaaattagctgggcatggtgatgggtgcctgtaatcccacctactcgggaggctgaggcaggagaatcacttgaacccaggaggcggaggttgtagtgagctgagattgcaccactgcactccagcctgggtgacagagtgagattctgtctcaaagaaaataaaaaagaagaaggagggtctcatacttgcgtatgcatcagaatcgcctgagggacccaccctgtttctgattcagaaaatctgagttggagcctggagatgtgccttttttgtttttttgagactgagtttcactcttgttgcccaggctggagtgcagtggcataatctcggctcactgcaacctccgctccccaggaccaagcgattctcctgcctcagcctcctgagtagctgagattacaggcccccaccaccacgcccagctgactttttgtatttttagtagagacagggtttcaccatgttggccaggctggtcttgaactcctgagctctggtgatccacctgtctcggcttcccaaagtgctgggattacaggtgtgagccaccgtgcctggccggagatgtgcgtgtctgacatattcctaggtaaagctgctgctgctgccctggaaaccacgcttggagaaccactgctctgaggccagcttcttcagcctcagtgctattgatgggcagcgtcattctcggtggggggttcctgtacattgtaggacgtctagcagcatccctggcatctacttgctacatgccagtggcagcccagtgcccagttgtgacaaccagaatatctccagacattgcctaatgcccctgggaggtaaaaacatccctggttgagacccactgggtcgaaaacctcatgctccctcctccccaaccccagcccaagtggaagcattccattccccctgatgtgaatggcctggacccctgaagcttcccgggtcaggagagtggcagtttctggaagcttgttagaagtgcagaatctcaggtcctgtggacaagatccccaggtagcctgtgtgcagggtatagagtgaaaggccctctccactgccaaggacgagtaactaagttctgtcaggcacctactctgtactgggtcatgctcctccaacttgaatgcacactggaattgcctaaagagctctaaaaacactgatagctctttaaattcattttatgttatgtgtgtggtctttgtttttttttaagagagagggtctcgctccgttgcccagggtgaagtgcagtggtgtgatcttagcttgctgcaacctccacctcttgggctcaagtaccttctcctcctgcctcagcctcccaagtggctgggactacaggtgcatgccaccatgcccagctaattttttgtatttttgatagagacaggattttgccattttgcccaggctggtctcgaactcctgggctcaaacgatcctcctgcctctgtctcctaaagtgctgggattacaggtatgaatcaccaccgttatgtgcattttgcatcaacaaaaatatacatatttatatactagtggatgtggcctgggcatcgggatgtttttaggctccccaggtgtttctggcgagcagcccagtttgagagcagctgtgttattaaggctcttccctgctccatatcatttcgccctttcaacgtaagagctgggtgctcttatgtccattttgcaggtagggaaactgaggctagaaaaggctggagaacctaagccaaggtcacggggtaagatgcacagctgggatttgaacctgcttctctgagtctctgggcctctgccctcagcctgctggctgctgactgctcctccgtgcgctggtggaccctgacgctgcccccagtgtgaggggacaggctggatgctgggggtgtgtgctggggcggagtggacattggaggacagctggtctgtgtgtgcattttttatttgaggctgggaggcagaagtcttgatggatgtggggtggaggcacggccgggtttccctctgacacccgacccagttccactctgagaagtccccggcacctttgctggtgcagtgcttggctgactcagctctgaccatcccctctcttctctcttggcagtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaatgtgcgttccgtttctgacttccacagctgcaggaaataacgagggtattgaaagatggagcgctcccctccggcagggtcatgtggtgggaggcttagaagcagattccagtcgcgatttccgtgccaggactgaaagaggggcttgaacgaatgtcatggtgctcttgcgtggcttccagctgctcttacaggaccagggacaggacttatttctgccctgatctttctccagaattccccctaagggtcactgttctttttttgttctttttgttttgttttgttttgagacagagtctcgctctgtcacccaggctggagtgcagtggcgccatctcggctcactgcaacctccacctttggggttcaagagattctcctgcctcagcctcccaaggagctgggattacaggtgggtgccaccacacccggctaattgttgtatttttagtagagacggggtttcaccgtattggccaggctgatctcgaattcgacctcagatgatccgcctgccttggcctcccaaagtgctgggattacaggcgtgagccacctcactcagccgttaactgcatctcaatacccaaatgagattggctttggggggcttccattgtctcggagctggagtgggacctgacttgtaggccggccctgcatgaactaggaaggaagccttgggaatgcacaagccggagtgtggtctgatcactacgcgtgtcatctccctttctcatctcagctgcattagtctctcccgcaagggaaaggagtggggtggggaagtgggttctgggcccctgttttgcctgccagtctgcaggcaggcccacctttaccctcctaaacgtcctctgaacagccattctctcaacagcaacctgactgcagacccagaacagccagcttaggaggagagactggagcttaacctgctcctggagagagacagcagcaaactccaccagaccccttttgcctggaacagcaggtggagctttcaccacgagtgtcccaggctgtcatttggagcccacgacctacccacggggagcagccaacagagtggtttcttctccaaagctaattcatctccaacgagctttctccccctccaaagctgtacagtcttaaatttaggaccagcaggggtgtttccacaatctcttaactccccacattgcagatcagtcaagaagcctggtgtgtctgttgacagatatacccatatggaaaattttaccttcctttcttccccttttcattcatttaaaaatggattgccaccaggcgtgctggctcatgtaatctcaacactttgggggtccacggtgggggtcaaaggcgggaagatctcttgaacccaggagttcaagactagcccaggcaatatagtgagaccccatctttaaaaataaatactgcagggtgcagcagctcaggcctgtaatcccagcactttgggaggctgagacgggtggatcatttgaggtcaggagttcgagaccagcctgtccaacatgatgaaacccccatctctactaaaaatacaaaaattagccgggtggtagtggcgcacacctgtaatcccagctacttaggaggctgagataggagaatcgcttgagcctaggaggtggaggttgcagtgagccgagatcgcgccaccacactctagtctgggtgacagtgagaccctgtctcaaaaaataaataaatacataaataaataaataatggattgattgattaacacaggagccaatgaactagagccagtgagcccagccggccagctgccttggaaggcctgtgggtataaaatagtttttatatttttaaatggttaacaaaaaaatcagacatttgcaactattttttggcttttggtttgtttttttttcccctccttttttttttttgagttattaagaaaaaacaacaaaaaacacaaccaaaagaactgacgagaggaagataaagcctcgggatcagccagagaccgagtggcatatgggatgaggcacaggtcaggtctagctgggtctgtggagcaaggtggtgggaagtcccaaggcctttgggcctgtggggtctgcggaaggagaggaggtcacttaagaaaatacatatactgtacacatctatacgacgcgtcccatgttgggggagtggggcgaggtcatgggagctggtccactctctcctcggaccagcctccccgcaggctcactggcttggccagcacagggacccctgcagctggctgttgtcttctgtggagcgagggaaggtaacagtttagctcccacccatggtgggcagaggtcagcggaggtcagaggcatggagatggccaccgctcagctaggaaatccctgtgcctggtgctcgtgcccgtcatacagtctgctttgctgtcttctttctactttttccttctttttcttctgggacggtgactcagggtctttggttgaggatttttttgagacagtgacttgctctgtcgcccaggctggagtgtagtggcacaatcttggctcactgcaacctccacctcccaggttcaagcaattctcatgcctcagcctcccaggtagctgagattacaggcgtgcaccactacgcctggctaatttttgtatttttagtagtgacagggtttcaccatgttgtccaggctggtgtcaaactcctgacctcaagtgatccacctgccttggcctcccaaagtgctgggatttcaggcatgagccaccgagcccagcctgcaactaattttgatggtcgagaacactgtgaacctcaattaggcaaaatttatctccctccccaaagattctgttcttctcaatagacctgtattaccaaaaaattgtacttaattattataacatttttatttcatcaagtagaaaactgtggaaattggccaggcactctggctcacacctgtaatcccagcactttgggaggccgaggcagatggatcagttgaggtcaggagttcaagaccagcctggccaacatggtgaaaccctgtctctactaacaatataaaaattacccaggcaaggtgatgggtgcctgtaatcccagctactcaggagactgaggcaggagaatcgcttgaacccaggaggtggaggttgcagtgagctgagaccacaccactgcactccagcctgggcaaccgagcaagactctgctcaaaaaataaaaaataaaaaaatctgtggaaattggtttcctttcttgtcacataggtacctatgccaggtatggtgactcacacctgtaatcccaacacttggggaggctgaggcaggaggagcgcttgagccctggagtttaagaccatcctgggcaacatagcaggaccatgtcttaaaataaaataaacattaaaaaagtaagtacttacatgttacctttcattttgcctcttggcccaaaaagcctaaaatatttattccattttctagtagtttacagtttgctggcccctggctgagcacaacaccacgttgtctaaattccgggactacagaagtatctaaggcaatcagggtccttgacttcatgtagtttagaaattagcaaggaagacaagtaacattatcaacactgacttgcttacatacaaattcagggtctcatctggacatttggttaaactccttgaatcttgggcctcctgtttcggcttgtctaattgtcatcgtctttcttcctttctttttttctttcttttcttccttccctccttttctttgcccctcttctctccttttttctttttaattttcttttctttccttacagggtcttgttctgtcacccaggctggaaggcagtgttgtgatcttggctcactgcagcctccacttcctgggctcaagccatactcccatctcagcctccccagtagccgggactacaggcacaccaccatgcccggctaatttttgtatttttttttttttgtagagatggggtttcaccatgttgctcaggctgggtcttgaattcctggactcaagcaatctgtctgcctcagcctcccaaaatgctcagattacagtcatgagccaccatacccggcccatcatcatctattctgattacaaaagaatgtgtgtggtgaaaacatttcaaactttacaaaaatgtgtgagaaagtgaaaatcccccataatccatcaacccagagcaaaataccaggaccagtttggttcacattctccaggttttgtcctaatggatgtgcagaaatacagtcacactatacatattcttctgcaattgctttttctacctcgtgctttatcttggacatcttcttttcattctttaaaacgtctctccacttttgggccaggtacagtggctcatatctataatcccagcactttgggaagccgagaccagcctgggcaacatagtgagaccccgtctctacaaaaaaaaaaaaaaatacaaaaattactgaggcatagtggtgtgcacctgtgtgtggtcccagctacgcaggaggctgaggtgagagaatcgcctgagccctggtaggtctacagtgagctgtgatcgtgccactgcactccagcctggtgacagagcaagggccctttctcaaaaaatcaaaataaaagaagtaaagcaatgggctcatgcccctgggagccaatggtttccccacatacccatcacccaaaagcagctggtctgacagaacaacaacaacaaaaatgtgtcccactttcaaccaccaatgcaggagtacagagaagagcggagactgtgtcagcaccagaatcccattgagaaaaaacactctggccgggcacggtggctctcgcctgtaaccccagcactttgggaggctgaggcgggcagatcacctgaggtcaagagttcgagaccaccctggccaacatggtgaaaccctgtctctaccgaaaatacaaaaattagctgggcatggtggcagtgagaggtgaagccagctggacttcctgggttgagtggggacttggagaacttttctgtcttacaagaagattgtaaagtgcaccaatcagcactctgtagctaggactgtaaaacgtaccaatcagtgttctgtagctagcaaggggattgtaaaatgcaccaatcggcactctgtaaaaatgcactaatcagcgctctgtagctagcaagaggattgtaaaacacaccaatcagtgctctgtaaaatgcaccaatcagcactctgtaaaatgcaccaatcagcaggagtctaaaagtagccaatctcagggaggattgaaaaaaagggcactctgataggacaaaaatggaacatgggcggggacaaataagggaataaaagctggccaccccacagccaaccacagcaactcacttgggtacccttccaccctgtggaagttttgttttttctcgctgtacgatacatcttgctgctgttcactctttgggtctgtgccatttttaagagctgtaacactcaccatgaaggtctgccactgcactccaacctgggcgactgagcaagactccatctcgaagaaaaaaaaaagagagagagaaaaaacactcttcccgcctgccaacaaattgtcgatttgatgggtgctttctggaagcacaatgcaaatgccttcctgaggctcacacgcacgaagcagcactcatgtttgtctttgaacaggcgaatgcaagtcagtgcccatggtcatggtagttatacacaagtctgtcaccctgtttcagaggaacttcacaagagctgttaagtcctaggtgatcaggtggacaaacgggtgctagtaacccatcaaccactggggaggagctaatggggagaagagcactccattgctgataggtttgaaagagtttttgcaacatctgagggcaaggtcaggcaggcaactcaaagtctagactgatgaggcctggatctgggagacaacacatagatgccgtcactaatgctatggagagagtggaagagcccagaaagagtgggcagagtccagtatgggaccccaacatttgaggagcaggccaggcgtagtggctgagcctataatcccagcactttgggaggctgaggccagccgggccaacatggtgaaatttgagacgatcgaggccaacatggcgaaaccccatctctactaaaaaaataaaaaattagccggctgtggtggcacatgtctgtagtcccagctacttggcaggctgaggcacgagagtcacttgaaccctggaggtcgaggttgcagtgagtcaagatcactccactgcactccagcctgggcgacagagccagacgccgtctaaaaaaaaaaaaaaaattaaggagcaggcagaagaaagagctgagaaagaataaagaagcaggaaggaaaccggagagctggtgtacgggaagcgatgaggggaggcctcgcggaggggcacggggtggtcctcaccgacaaaccaccccaggtagaacaagggctagagagcacaagcgactgggcaaaaggtcttagcctttacctggctctcaagggagaggttcctcctcctgtggaggcgggaaagaagagctgaccagggagaaatgtttgaagtttgtggttgacagcctggcacagcctcttccaggactccctcaaactccggatgccctgtggtgacccagagccccacaccctgactccgcagtctcccgggtctcagccagaatgggaggagagcaatctgattccacctcccctgcgattcctggcagttgccccatccctctccagccttcccatctccaccgttcctagcagatgtgctgtgcactaggggcttttcaggcaaaatagaggcgccttgtcagagaagcagaaggtgctagccacccagggcttacaaggatgtggggtcttcccaaaatgccttaaaagagtttctggccaagtgcagtggctcatgcctgtaaccctagcactttggggggccaaggaaggaggatcacttaagcccaggaatttgggaccagcctgggcaacatggtgaaaccctgtctctactaaagatacaaaacttagctgagcatggtggcatgcacctgtggtcctggctacccgggaggctgaggtgggaggatcgattgagctaggaggtcgaggctgcagtgattgcaccactgcactccagcctgagggaacgagtgagactgtctcaaaaaataaataaaatattaaagagaaaaagggggtcgggtctggtggctcaagcctgtaatcccagcactctgggaggccgaggcaggtgaatcagttgaggccaggattttgagaccagactggccaacatggtgaaacaccatctttactaaaaatacaaaaataagccgagcatgatggcaggcatctgtagacccagctctgtaggaggctgaggcatgagaactgcttgaacctgggaggtggaggttgtaggaagccaaggtcgcaccactgcactccagcctagggacagagcaagactttgtctcgaaaaaaaaaaaaaaaaaaagagtttcaacctttccaaagtctccttttccagttgatcccagaaatgcactcggatatggctcctactctgtcttccactctcctattttgctttctttggacacggactacgaatgactttttttcattctggggccccttatttcccaagaaaagccacacctgcatgagtggagtatgtcccttggcaagaacagctgcctctggttagtcaaatattgctcagagctctagaaaagcagaaggcaagggaccttgaggagggctcagcaggactgaccccaggactacagttccagaaaaaatacaagggagtttgggcatggtggctcacgcctgtaatcccagcacgttgggaggccgaggcaggtggatcacctgaggtcaggagttcgagaccagcctggccaacatggcgaaaccccgtctctactaaaaaatacaaaaattagccgggcatggtggcgcgtgcctgtaatcccagctacttgggaggctgaggcaggagaatcacttgaaccagggaggcggaggttgcagtgagccgagttcatgccactgcactccagcctgggcgaaagagcaaaactccgtctcaaaacaacaacaacaaaaagaatgcaaggtagccttgccctggggtggcagaatggcagagagagatctggtctgcattagcaaaagtgcaactagtgttacttaaccgctagcaacatgagggcttggtgggcttgccattgatgtgatgaattccatcctgggaagcttttacaaaccaggccctcccacaagcactgtgactatgaagatgaatagaatgaggtttccactttctaggcactcacagtcctggaaggaagctggcgaggcaggcagacgctttggtaagggggtgccgcagcagcgagccggcagaacgtgctgcctgcatctcactcctgcaaaccacgtgcagcttgttttcaacattggcgggaagagcagatggttcctaccaaatgttattgtattgcacattatgagccaagcaaagttaagtctaaaaaagtgactaacgaatctctcatgcaggattccaaataatttatctagatactctgccttcgagaaggtagcacaaggctgggtgtggtggctcatatctgtaataccagcactttgggaggccaaggtgggtgagtcgcttgagctcaggagtttgagaccagcctgagcaacatggtaagaccctgtctgtacaaaaagtacaaaaaaaatagccaggtgtgatggtgcacacttgtggtcccagctactcggggggctgaggtagaaggattacttgagctggggtggggcggaagttgcagtgaggtgagattgcaccactgcactctagcctgggtgacagagggagaccctgtctcaaaaaaaaaagaacggtaaaacataggctgggtgcagtggctcacacctgtaatcccagcactttgggaggccaaggcaggaggatcgcttgagcctaggagttggagaccagcttgggcaacatagggatgacacagggcaggtaaggcccaaattgaggcttagcccgggagggttcttggctttgcccaggaaagaattcaagggtgagccagtggcagaggaaaactgcttgattgaggtggcagtgctacagctcatgactgctcctgcagagcagggctacctgtaggcagtgtgcagagactagcagctcagaagcagttttgcagtcatatttatgcccatttttaattacatgcaaattaagaggtggatcatgcagacatttctagaaaaagggtggtaacattcaggtcattgggtcattgccatggaaggggtggataacttccaggtgttgccatggcaatggtaaattgacatggcacactggtgggcgtgtcttatggagagctgcttccgcctcttccctattttagctagccctcagtctggtctggtgtctgagccctgcctccagaatcaagtcctgcctcttacctgtggctacaaaaaatgaaaaaaattagccgagcatgggtatgtgcacctgtgttcccagctacttgggaggctgaggaggggggctcgcttgagccctggaggttgaggctgcagtgagccatgattacaccactgtaccccagcctgggcgacagagcgagaccaaaaaacaatgtgaatgaacttaataccactgaactatacactgaaaaatggttaagatggtaaattttatgtgtagttcaccacgcacacaaaaattgggactaaagggggacacagcagtggaacgggttgtggcaatgcctggggatgtccagggccaggggcggctctcagcaaagaatttctgctgccaattatgctgtgattgggtgaagatctgagaggcaccgcaattgttttcaaactaggtccttgtgaatacttctaattatatgacctcacgccgaggcagccggccaaggggtaactgtttggccagtgaacagagctgccctctgtggtcggtggcctgcagccttctgggtgagggtgggggtggggagcctgtactaaattgttggataatatggtaaaggtggctgcagtttcctttcaacttttcctatttccccttctaacccactttcccacccacaaaataatgtgtcttcagagagccctcggcttcccagggctggaggtggagtggaaagggttgcattatgattgcaaccccagccagccactacctcatcatggagtggatcgtttcctattcttggagactttgggtctgattcacctctgaccacacaaagccatttcaatgcgtctttcaggagctcctccacccagcccctgtcaggaccctcagcacccacccctaagagttctttgtcccgagaaactggtgcgagccagaacggatcaggagagattggtggcagcagtcatttaggtgcttgtctttggttagtgcggccctgcaaggtgccgtctcattgggaatttccttgcacctgccccactaaaggcaggtgggtagtggtgacaacacatatatggagaagttgggaagtgggagagaaacgtttgcttccttcctgtcctttcacagatcccaaacccgctgagggcttcccatggaaagctgtctgggcccctcagcctgcctctcttgggaccccccacagactggccctggctgacctttgcaaattcctctctcatttttcccctgcagggactctcaaccccagccagactgatccacccaccatcctcgcaaaatgcctttcttccatgacgactgccccttccttccttgctcacgccatgccctcccccaatctggaacgccctccccactcctcttccctgcaactcataaccatttttcaaggcccagttccaaccccaatcccacttcttggatgacgcactcctcttctgtcccagtccaaatttccgatgtcagcatctgaactcgggataacctcattccccgagctgccactcattcaggcaccagtagctctggacgggggctggacacgcccctgtgttgtctctcacttaatcctccccattatctaataagcaccgccactgtcctgccactttgcagatgaggatagctgagtcttagaaaaggaaaggaacttgcccagggccatgagattagtaggtagccaatctgggattcaaattcatttttttctagccccaaattcccttgttttaatttacatgatcgcaattgccttaactccctgagaaacatgactcgtttcattcattcaaccattcattcaatgaacacagtacatttcgtgccaatcacccagctaagctgtaaaaatccccagctttgccgggcgcggtggctcacgcctgtaatcccagcactttgggaggccgaggcaggcggatcacaaggtcaggagatcgagaccatcctggctaacacggagaaaccccgtctctactaaaaatacaaaaaattagccgggcgtagtggcgggcacctgtagtcccagctactcgggaggctgaggcaggagaatggtgtgaactcgggaggcggagcttgcagtgagccgagatcgcgccactgcactctagcctgggcgacagagcgagactccgtctcaaaaaaaaaaaaattccccagcttctactcccaaggagtttccattctggtggtgcgggaagatgtctttattacagaaagtggaggaaggatggtagcagaggggagggcagagttataattcccactgaatggatgcggaaactgaaggaaggcaggacaacacagtcggccaagatggtaagcagagcccgccatcaccacccagggatcagggcttcccaagcactgactattcttccttgcattttctgggtgccttgctcgatgcaaatgcatacaaacgtaggcttggataagcgccttggcaacgcccctacaaatattcatgatcattattagtatgttaccaacctattggttaattcttctcctaactcaggagacctccaaaaagaagagggatggcctgcgcttccgacgtggcaggaaaggagtcacgtgctccggggtccttccgcgtcgccccgcgcgtccggagccaggccggggttgccaagcaaccggtaaacgccgccgtttgaggagcaccggagccgcgaccgtggattgaacgcttccccagagacccagaagcagaaggagcggacccagggtaaggggcgggcgccaggaggacgtcggaggctaaagactagagtggagagtgacagggagagacttacagggtaataaccaccaagagtgccaaacattcctcttggggggcttccttctgggatagctctgccagatggtggctgccaggactagcgctcctagtgccctcttccccttagtcctcgctgccctggatccgccccaagtcgcaggaccctgcagcctctgtacaccctgcctcataccctcctacccactcaggtcctgatacagtccttgtcctggagtggactggagacctctgaaggatttacagctgaatggatggaaaaaaaagaagaaaaacagcctccggctagggtgatgggaagatgggccctttaagaggagagctttctgctcaggatagagggatgtaaattaacagtattgcacacctgctaggtggcaggtgttttaagtgctttctttcatttcttcctcaacctgggagctggcgttctcgtgtgatcgaggtcatacagttggtgagttcctccggagcgtgtgcagttcctccttcctgctcaaggtcaaggtttaccacattctcttgaaccacagaagtgcgtcttctcccagctttcagaccctatgtgttttcctctcgaatccttggtttcaaatcctttgcttgtttgtcacggtcagcagaggaggaacaggggagagagctgtagagagaagcctggtaggcgctggtatcacagtcactaacgcagcaggtgacaggagtcttgggccccttctatgtgccagtccctggggacgggagtgaataaaagaccacagtctttccgtcaaggagaccacaaggtagttgtgagggcaggtagtcactgacccccatcggtctccaattctggggacctcttcccaactcgtcctgccctcaaccttcactttccttggggggctcagccatgcttagtgctatcctgggggaaaataaatgggggctttctagggaggtctgcctcttttgagggtagagtgagtccctcaggaccccggaattccagaaggtgcacaaggacataagaaagagaaagaaagctgggtgcggttttcacacctgtaatcccagtgctttgagaggcccaggaggatggatcacttgaggtcaggagtttgagaccagcctgcccaacatggtgaaaccccatctttactaaaaatacaaaaattctggccgggtgcagtggctcacgcctgtagtcccagctactcggcaggtggaggcagaagaattgcttaaacctgggaggtggaggttgcagtgagctgagatcaggccactgcactccagcctaggtgacagactgagactccgtctcaaaaaaaaaaaaaattagccgagtgtggtggcatgcaccagtagtctcagctactcaggagactgaggcacaagaatcgcttgaacttgggaggcagaggttggagtgagccaatatcacaccactgcactccagcctgggtgacagagcaacactgtcccaaaagcaacaacaacaaagaaagagggaaggaagtcctctcctgccaggtgccatgcagggcccaccactcgcaggaacccagtaggggctgtaccagggaccaagaagaagaggaaaatgttctcatctccttattccactagggagttcaatgtggagggctgaccttccagcttgcctccttcccagtctcccacgctgacactcctcctccccatcactcccttggccttcctcccagcttggaaaacacactttcccttaagccaccggaggttctctccaggaattactttgctcattctcactgcacaagacgagttttgtttttatagtgagtgaaggttcccatctgactgcctccccggggatgcgggagacgcctgaatctttgatgtctggaccacagcgtccctgattctgcgtgttcctgtgtttgagactcacagtggtgttcttcacgcctctgggactctaggttcccacggggggaggatctccccccaaaactccagagggcagtgacactgctcccgtccccgctctgtcaccccatgcagacactcctgctcaggccttgcttggggaagcccaccctctagcactagtctcacaagaggttgggggagacctcctgagacgccctttgctgaccttgctattcatctgtgtgccctgctagcttgtgagaagagcttgctctgggtccttgaatgggttgtcttcccgtcaccaggccagtctttaaatgtcccctctgtctgcctccagacacaagacaatgcctctgttctcactcggggcttggccttgggaaacaccaagaaggaaagcaaagctgttaaaaatctgatctgggctaaagaggctatttctgtcttcctggagtttcctcattctcttcaatctccttgtgtcccctaggagccagctggcttgcagcaatttcttttaaaagtcagagacaggcagccctaattgcctgagtcctgcagccccatgtgggaggcacagttgcttcacactgtgttggcaaaggggaggatgccacgggatttgcatgctttttcacaaggccgtagctttgtccatgtggtaaaaacacactggggcaccccgctacaatctgggcttctcatcccaccctgtgccctctaagccattgctcccacccaggaaagagaatttccaaactacaagaaagagaagaaaacaaggctgggtgcggtggctcatgcctgtaatcccagcactttgggaggccgaggtgggcggatcacttgagatcaggagttcaagaacagcctggccaacatgctgaaaccctgtctctactaaaaatacaaaaattagccgcgaatggtggcatgtgcctgtaatcccagctacgggaggctgaggcaggagaatcgcttgcacccgggagacggagtttgcaatgagcctagatcttgccactgcactccagcctggacgacagagcgagaatccatctcaaaaaaaaaaaaaaaaagaaaaaagaaaaaaagaaagaaaatgccactttctgcaacagtctggttaaggttgagttgctctggggctaggagtgggatggggtggtactgtcttcaagacacaatgtatatggatgcaaagggttaaccttcctaccctccttctccccacctgctgccccagctgctccagggcccaagttccccctggcacatgcttctaggggcacacagctcctgccctgcctctcaggggccagcggccaggacccactggtctggtgccttgtagccctggaggcgggagagggtaggtaagacacaggtctggtagtcatgttcacctagggtgattgtgaaaaacacgaattgctaggccctgccccaggcatctagttcagcatttgcaggagagaggcctgggagtctgtgtatttttaaggaagatcccaggtttcagaaacgctggttgagagattaagttccctcactttaaatcaatggtcctcaaagttggctacacatggaattgcctggagaattaaagaaaaaaagcatatactgatgagagattctgatgtagttgttctggggttcaaacagcattgtgatttcacaaagccctgcaggtgtttctaaatgtgcagtcaggactaacaatcactgctttagagccagacatgcctggtggttctgcctgaactgaagaactgtgacctttggccctgtattaatacttcatctctccaggcctcagtttcttcatctcgaaaatgggctcatgcctataatcccagcactttgggaggctgaggcaggaggatcacttgagcccaggagtttgagacaagcctgggcaacatagtgagaccctcaactctacaaaaaaaaaaaaattagtctgatgtggtagtgtctgcctgtggtcccagttactcagaaggctgaggtgggaggattgcttgagcctgggaggttgaggctgcagcaagctgtgttcatgccactgcactccagcctggatgacagagcaagacactgtctcataaaaagaaatgttagtgagaattgtgatcactctttgggagtggtgctgggcatgcaggaagcacgcctggaaactgttgttcatagtgcttgcaacctggtcagtctttacatattctggatgcaagttctttatcaaatagataatttgcagatattttatccaagtctgtggcttctctttttgttaacattgttggccgggcatggtggcgcatacctgtaatcccagctactctggaggctgaagcaggagaaccacttgaacgcaggaggcggaggttgcagtgagcagatatgccactccactccagcatgggtaacaaaatgagattccatctcaaaaaaaaagaaagaaaagaaaagaaagaatgaataagacctactatttgataggacaacaaggtgacaacagtcagcaataacttaattgtacatttaaaaataactaacaggccgggcgcggtggctcacgcctgtaatcccagcattttgggaggccaaggtgggtggatcatgaggtcaggagatcgagaccatcctggctaacacggtgaaaccccatctctactaaaaatacaaaaaattagccgggtgtggtggtgggcacctgtagtcccagctacttgggaggctgaggcagaagaatggcgtgaacccgggaggcggagcttgcagtgagctgagatcgtgccactgcactccagcctgggtgacagagggagactccgtctcaaaataaataaataaataaaaataactaacaaaggataaattcttgaggggatggataccccattctccatgatgtgactattaatatctagtatttgatagcacaacagggtgactatagtcaaaataatttaattatacatttaaaaatagctgaaagagtataactggattgtttgtaacacaaaggataaatgcttgaggggatggatggataccccatttcccatgattgtatattgtatattgcatgcctatagcaaaacatctcctgtgccccataaatatatacacctactatgtaaccacaaaaattaaaaattaaaaaaaaatagcaaaacctgctcacaggcaaacctgctcacgtaatcctgtttttgagatagagtcttgctctgtcatccaggctggagtgcagtggcacaatctcgactcactgcaacgtctaccttccaggtttaagcgattctcctacctcagcctcctgagtagctgtgattacaggcacgtgccaccatgcctggataatttttggtatttttagtagagatgggttttcgccatgttggccaggctggtcttgaactcctgacctcaagtgatccaccggcctcggccacccaaagtgctgggattataggcatgagccacaatgcccggcctaatctcttgggcgttgaaaggcctttggttgtaaatctaccaaggcaagctctccttcagtttatcttcctcccaccagcaccagccactcatccacatcttttgtcctaaggctctgtgcaaccccaggagccttgcacagatcctcaatctgagcccctggaaacttgctatcaaaggcacaatttctgaaagtgcaggtggctggcagacggaaatctctgctaattccatggtgtgatatggcaggtacacaggtcaaagcgccaaccactgaactcattgagaaagccctcagacccagtggagtctagtgatgtcatgggggagtcagaaaggtcaagggcaatatgtgggaatggcccagcccattgcatttttacaacttctaatcagcatcagtgagaaacccttccttgcgtggcctgtgaaccccgcctctgatgctgctggagcactttcatttcacttctcagcatcctgtgggtgtgtcaggtctcagaaagactaagtggccctgcctaggtcacgcagctggtgacgggaggcccagaacttgaaatcagggccgagcccagcccacttcccaattccctgctgtgtcccatgaccagtagcacgcgtcagaggctttcccaaaggcctccatgtcccgcctgttggggaagcccctggctttctctctgtctgggattgactctcagctctgtcctggttggagagaagagatttccaggatggtacccagacagtggtggaggccagagtctggcaaccaacgagccttttggacaattgggtggggagttgggtcattgggttggagaggaggggttcaagaagaggcccaggggtctcaaatctgtgtcctgtgtgtttcatgcccagcatggcagggaatttagtccaacatcatcaccatcaatatttcctcctgccctgtcaataaacactgattcagtaaaaaccgtattgtaccacgtgcgatggctcatacctgtaatcccagcactttgggaggctgaggcaggtggatcacttgagcccagaagttcaagaccagcctgggtaaaatggcgagaccccatctctacaaaacaatacaaaacttagccaggcatggtactgcacacctgtggtcccagctacttgggaggctgaggtgggaggatcacttgagcccgggggttgaggctgcagtgagctgtgagcacaccactgcactccagcctgggtgacagtacaagcctttgtctcaaaaaaaaaaaaaaaaaaaagccctaaaaacaaaagacgaaaactgtatcatttggtgggtaagagctttggaatgggggcagaccagctgcagcatgcattagctataggaccttgggcaagtcactgatggcatctaagcatcaaatgccttcaaagaaaatggtgattttatttatttatttattttgagacagagtcttgctctgtcacccatgctggagtgcaatggtgtgatctcggctcactgcaacgttctcctcccgagttcaagtgattctcccacctcagcctcccgagtagctgggattacaggtgtgcaccaccatgcccggctaatttttgtatttttgcagagatggggtttcaccatgttggccaggctggtcttgaactcctgacctcaggtgatccacctggcttggcctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggtgggtccctgccccaagggccctggcctgtcaggtgtggccaggcagggcggccagctggggccggtgagtggttctgtgggtccttgtccacctgaaagccagttagagtagaccaaatgcagatgctggaagtgagggcagaggctccccctgagttccacgcagtgctcagggtcagaggaagacccagcacccgccttcctcgagccagggaagtgcaaatcacaatgttccctctcccaagagctcttgtttcacctcgaagacacttaccagagttgttttggatgtttggtgtagctgggagacattttttttttaaacagggtctcactctatcacccaggagtgcagtggtacaaactcgacttactgcaaccttcgtttcctgaattcaatagatcctcccacctcagcctccctggtagctgggactacaggtgtgcaccaccacgcctggctaatttttgcaattcttgtagagatgaggttttgccatgttgcccaggctggtctcaagctcctgggcccaagtagtcctcccgccttggcctcccaaagtgctgggaatacaggcatgagccactgtgcccagcgtgggagagatattctgagggagcagagattcatatctacaggcaactacccagcttgagaaaagggaagtgtcccacagaaagttccagccagaggggcctccacgataagagaacttatcttgagggtcatggtcatgtgttcagaggccaaaaattccctgtctctatgaactaagtgattcaccctaattaggtcaacaactgctgagataaaatgataacgaaatcacttgatttggccaaaacacgtccaacagtcaggtgggtgtgggtggtttcagtgactcacagttcaaatgaattaggtgcttctctcccaggaccaactgctcccccggggatgagaaggactgtggccatggtgtagccaataagcagaatggccgctatgtgggccacaccctgggggccctcctgtcgtttccagcagctctgccttttccagacttgttttgttttgttttgttttgttttaacctttcctatggtgctgatccagattttaccttttgtgagagctggcttaaaaatggaaaggagatgggagtgacttcatgaggatggggtttccatcctgggtgatgtaagagttttggaactaggtggggttgatggttgcacagcactgtgtataataacgctgctgcagtgtacgctttaaagtggttatgtggtaaattttatgttacatgtattttaccacaatttcttaaaaacaggaagggctgggtgtgctggctcaagcctgtaatcccagtactttgggagaccaaggtgggaggatgcttgaggccacgagtttgagaccagcctgggcaacatagtgagacttcatttctacactttttttttttaattacccagttgtggtggctcgcacctgtggtcccagttacttgggaggtggaggcgggcggattgcttatgccctggagttcacagcagcagtgagctgtgattgcaccactgcactccagcttgggcaacagaatgagaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccagaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctgggcaacagagtgagagaccctctcttaaaaaaaaaaaaaaggaaagaagggaaagtggcgacacccacgtgtaaaactgtcctccctgctagagaggataggcaaagcaaatccaaacttggagttttaacgttcaatttttgtgacactgacattgtcagtgatagggtggcattgttaatgatagagtgaagaaaggctattcactttttcttttttctttttctttttttttgagacggagtctcgctctgtcgcccaggctggagtgtagtgctgtgatctcggctcactgcaacctctgcctcccaggttcaagtgattctcctgcctcagcctcccgagtagctgggactacaggcgcccaccaccacgcccggctaatgttttgtatttttagtagagacggggtttcaccgtgttagcgaggacggtctcgatctcctgacctcgtgatctgctcgcctcggcctcccaaagtgctgggattacaggtgtgagccactgcacccggccaattattcaccttttctttggattctcacagagcagatggacaggcttctctggtccattagaattcagataaggtcagaacaggattttcatgaccacagctaccagttgcaaagctgcttagctccacagggttgcgctgttgcagctacctgtgcccacctgatcaccaggaatttccttgcctgcatttgaaaatactgtggctccggccagggcgcctcagcatccagccctgggagcccccgtgggacctggcttgcagaagtggccgagggtttgggagtataccagggtgacgtcttccctcctgcggctctctgtttaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctgtaaggcttcctcctgccccagctgcaagagccccatccatcactgcagctccccaagggatgcactgccccagctgtgcctggccatcgctgtgaggctcgtgtgaatgctggggggaaggggaccagctgctacctcaaggagccttctgtctgggagcaggcagaggtcccaatcacagaccaacagggaaggcagggaggtacaagggctgaccaggcatcaggaggagtctgaccttgggcaaaggtgactcccaaagtgccccacccagcagccaatagggatcattcattcatttgacaaatttggactgaacttcaagcctctgccaggcacagtagaggttgcaaaatgaatctcataattgttctacatacttgccagtgcaaaaaaaaaaaattgttttaaggaaaaagaaatttaaaatttaaattaaaagaaaaagaatctcttatacatcctgtcccaaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagagagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggcagcagagcaagactgtgtctcaaaataataataataataataataataataataataataataattttgtttgtctagcatggtgttcttcaaccttttcttcattattggccttcatgttttttctaatggccttctgcctccataaaatgtttgttgttgttgagacagagtctcattctgtcacccaggcttgagtgcagtggcgtgatcttgggtctctgcaatctccacctcccgggttcaagcaattctcctgcctcagcctcccaagtagctgggattacaggcggctgccaccatgcccagctaattttcttttgtatttttggtagagatggggttttactatgttggccgggctggtctcaaactcctgacctcaagtgatccacccgcttcggcctcccaaagtgctgggattacaggcgtgagccaccgcacccagcccatcaaatgttaatgctatagacatactgtatatctgttcatgcgctgcatgtatttccatgctttgtacctaaaaagcaatattattttacccccaggaaccaattgaaaattcctccattgaaagcacatggttaggtggatgggaaaagcccctggctatgtcctgtccctcccagactccattgcaggcctgggcaatctgaaaggacctccatttactgcggagaacttccaatgtgtcccccctagatcatggagcactgcatcaagcagaacaatgccattgacatctatgaagagtatttcaatgacgaggaggccatggaagtgatggaggaggacccttcagctaaaaccatcaatgtgttcaggtagcgccatagccaggcaggtgtctggccaccctccgtcacccccatgcatgggcgcctccaaaggcaactccttgccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcgagtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccatccataggggactggttctagcagttctggcacacccacacgacggaatgccatgcacctggtaaagcgagcggggcagtctgggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcgggatgctgaggcaggagaatcacttgaacctgggaggcggaggttgcagtgagccgagatcgcaccactgcactgcagcctgggcaatacagcaagactctgtctcaaaaaaaaaaaaaaagcagtgcaacttcttatgtgctgatatggagtcatttccaggattcagtatgtgaaaaccaaaccaaaacaaagccggtgcagaacagggtgtgcagagtgccactttttgtggcagtccccaacttaaaccattttttgtctttgcaaggctgcaaaagcaatgcaaatccaggagaaaccgtacttcaagtacccatacaaccattctgttttccaccctcagtacagtattcagaaaattacatgagctgttcacctctttattataaaataagctttgtgctaggtgattttgcccaactataggctaatataagtgttctgagcacataggctggactaagatgtgatgctgggtaggttaggtgtattcaatgcattttcagctcctgatatttccaacttactatgggtttatcagatgtagccaacatcattagataaggagcatctgtatatgtgtataaatatatgcatatgtgtatgtgtgtatatatgtgtagatgtatgtttacatgcctgatgtgaggagaacatctgtgattttggacttctggcatccggaactgtgatagaatcaatttctgttgtttgaagccacgcagtttgtgggacctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagaaagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcctgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctgggctctaacctcgtatatggaccaccagagcaggatgatgcattagaaatcatccgaggggccgggcactgtggctcacgcctataatcttagcactttgggaggcccaggtgggcatatcatctgaggtcacgagtttgagaccagcctaggaaacatggtaaaaacctgtctctactaaaaatacaaaaattagccaggcgtggtggtgtgcgcctgtaatcgtagctactcgggaggctgaggcaggagaattgtttgaacccaggaggcagaggttgcagtgagccgagattatgccactgcctgggggacagagcaagactccatctgacaaaaaaaaaaaaaagggggagaaattggggaacctcacatccagccttctgctctcttccctctcccctgcagggacccccaggaaatcaagagggctgccacacacctctcctggcaccccgatggcaacaggaagttggcagtggcatactcctgcttggattttcagcgggcacctgtgggcatgagcagcgattcatacatctgggacctgggtgagaagcagcggggtcctggtggcctgggagggctgagggctgggaccagcacaagtggaggagcgggagggaggggcaggaggtcaaggacactcacgcggttggtgcctcaagggaagggcccgcagtcgaggaggaacacactcttctccttcctctcttgtctggtttcaggcagagccaagcagagtcaaatcagaagcaggaaacccccaccaattccagattcttagttcgaggcatgaagacctgaccccatgggatctcaattcttagctcctaaggagcatatcaggccgggctcggtggcccatgcctgtaatcccagcactttgggaggccaaggcaggtggatcacctgaagtcaggagttcaagaccagcctggctaacatgataaaaccctgtctctactaaaaatacaaaaattagttgtgcttgatggtgggtgcctgtaatcccagctacttgggagactgaagcaggagaatcgcttgaacccaggagtcagaggttgcagtgagccgagatcatgccactgcactccatcctgggcaacagagtgagactctatctcaacagcaacaacaagacagagtgcccagcagactgagaagggactcaaggggcggcggaatggaacttgtgcctttgtcccatctgtcctgacacttgcctttaattcatggcctgcaggggcagcgtgtccatttattagcacaaaccattgtctacagaagggctggcaagacacaggcagggacagggtggtggtggcttcacgctctccagcttcccttcgttgtcagcattattaaaataaacatgtaggtgccaggcagagagctaacgcccgacattccaacagctcagcgagttctggcagcagccctatggggtggactccgtcattatctgcagtccacagacctggttggaagaaaccggcagagagttgactttgtgtaaaaactttagtatcaaaacctcgtttcacaccaaacctaggaactggactagaaatataattatcacacacatacgcacaccccaatcctgttcaccaaaaataaaaaccatcagcaaagcccctagggtcaagaatgccagattctggccaaggtggaccagggggtgcaggctggggaaagactggaggggcttccaggcttccccctctgccaccatgcccccgctacccacccgcagaaggggtgaaactggttgatcctgtccttttctttccgggcctggtggggataatttttttgtgctttatagaaaaccccaacaagcctgaacttgctctgaagccatcgtctccactcgtgacgttggagttcaaccccaaagattcccacgtactcctgggtggctgctacaatggacagataggtaaggagggacctaggcttttttatttttatttttattttttttagatggaattttgctcttgtttcccaggctggagtgtagtggtgcaattttggctcactgcaacctccgcctcctgggttcaagtgattctcctgcctcagcctcccgagtcgctgagattacaggcacccaccaccacacctggctaatttttttgttatttttagtagagacagggtttcaccatgttggccaggctggtctcgcactcctgacctcaggtgattcacccacctgggcctcccaaagtgctgggattacaggtgtgggccaccacacctggccgggacccagattcatagtcagagccaatcctgctgctatagggcagagcccacatggcagcctgggctcggccacagaagactaagtggggtgagggcctcccatagctgaccaactgcagacacgggtgaggcaggtttggctgacacctcagcagtgtctcctgttactactgtaagtctaaaattagctcaaaataaacagttttaaaaaactatagttcaagtaaaatcagagaatatttgactaggggccgccataaagggatgatgagagcgttggggagccctattttgggagaggtttctgggaaacctacatgctaacggatatgggtaatactggccttatagaatgagttgggaagtattcccttctggaagtttgtgaagaattgatattaattttttttttttttgagatggagtctcgctctgtcgcccaggccggagtgcagtggtgcagtctcagctcactgcagcctccacctctcggattcaagtgattctcctgcctcagcctcctgagtagctgggactacaggctcatgccaccacgcctggctaattttgtcttttttcagtagagttagggtttcactatgttggccagacttgtctcaaattcctgacctcaagtgatcctccctccttggccttccaaagtactgggattactggcgtgagccaccatgcctggccgctattaattcttgaaatgtttggtagaactcatcagtgaagccatctggtccctggcttttctttattggaagcttaaaagttacaattcagtctgtttatttgttatagatcctcttcacattttctgtttcttctttaattgcttttggtagtttctgtctttctaggaacttttccatttcatcaagttgtctagtttgttgacatttaattgttcacagtattcccttataatcattttctttttctttttttttttttttttttgagacagagttttactctgttgcccaggctggagtgcagtggtgtaatcactgctcattgcagcctcgacctcctgggcccgagcaattcttccaccccagcctcccgagtagctgagcctacaggcatgtgccaccacactcggctaatttttgtagtttttttagtcacaaggtttcatcatgctgcccaggctggtcttaaactcctgggctcaagggatccgcctgccttggctggcctcccaaagtgctgggatgaaccaccacacctggcctgatttcagtcttttaaaatttattgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccgtgttagccaggatggtctcgatctcctgacctcgtgatccgcccgcctcggcctcccaaagtgctgggataacaggcgtgagccaccgcacctggcctgtccagtggagttttctatagttgtctgggaggtcttgtctatagtgttggtcaagacttctatttccttgttgatctttcacgtagtaattatgtctattattgaaagtaggatactgatgtctgccattattattgttgaattgtctatttctccttcaattttgtcaggttttgcttcctgtatgttaaggctatgttattaggtacatgcacatgcttataattgttaagttttcctagtgaattaacccttttatcagtatatgatgtcttcatttgtctctagtagcatttttcatctcaaagtctgtctttgagataagcactccagccctctttggttaccatttgcatggtatatctttccccatccttttacttttaacctgtttgcctctttgaatctaaagtatgtcttgtagccaggtgtggtgacacgcacctgtaatcccagctacttgggaggctaaggcacgagaatcgcttgaacctgggaagctgagattgcagtgagtcgagatcatgccactgaactccagcctgggtgacagagcgagactccatctcaaaaaaataaaaataaaataaaaaaataaagtatgtctcttgtagattacatgtagctggcatacaagtgaatcatagttttgttttgttttgtttttgagacagagtcttactctgtcacccaggctggagtgcagtggcgtgatctcggctcactgcaacctccgcctcctgggttcaagcgattctcctgcctcagcctcccgagtagctgggattacaggtgcatgccaccacgcccagctaatttttgtagttttggagagatgaggttttaccatgttggccaggctgatctcgaactcctggcctcaagcgatatgcccacctcggcctcccaaagtgctgggattacaggcatgagccaccacgcccagcttggatcgtggttttttccttttaatctattctatctatctctggttttaagtggagagtttaatctatttacattaatttaattactgataaagtttacatctgccattttgcttttttttcctatatgtcttacatctttttgttctttctccataactgccttcttttgtgccacgtattttctagtgtaccattttaattcccttatcatttcttttttttttttcttttcttttttttttagagacaaggtctcactctgtcacccaagctggagcgcagtgctgtgatcatagctcactgcagcctcaaactcctgggctcaagcaatcctcccacctcagcctcctgagtggttgggacaacaggtgcacgtcaccacactcagctacttttttattttttaatttttgtagagatagggtcttgctatgttgcccaggctggtcttgaactcctggcctcaggcaattctcccaccttggcctcccaaagtgctgggatttcaggcgtgagccaccacactcaacttaagctattgatcttattgatgatcctgtgtatgtgatgagtcatttttctcttgctgctttcaagagtctctgtcttcagctttgattatgatgtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatgtgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttctctgctatatttttattttggttaatgactccagaatttctattttgttctttcttttaaaaataatttctgtctcatttggatgtggtggctcgtgcctggaaacctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtctatttgtatcttttatttggtgagagatcatctcatgcttttctttagttcttttgatgtgacttcctttagttctttgaacatgtttagcatagctgatgtgaggcctttgtctagttagtccaatatctgggcttcttggggacaatctctatttattgcttttttattcctgtgtttgggccatacatttgtatttcttggcatgtcttataattttttttttattaaaaactatactttttgtatgatttaatgtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcagccaggcagttgtcaactctgccttagtgtctgtgcagagatgaggtcagccagagagtttagggctttatcggttttcctgagcatgacacagctctgggcgtgcacacagctctatccatgcttgtgaccttctagactcccaggaatatgtcagatcttttcaaagccctgtggacacatcatgcttcagcttttccttttacttatttacttttgttgtttaaatgtaatagaagttgagcacagtggctcacgtctgtaatcctaacactttgagaagctgaggcgggaggatcgcctgcattcaggagtttgaaactagcctgtgcagcatagtgagatcttgcctttaaagagagagagagagagagagaggagagagagagaggagagagagaggaagggggaaggagggagggagggagagagagagagagagagaaagaaagaaaatagggacagggtcttgctatgttgaccaggttggttgtgaactcctggcctcaagcagtcctgcctcagcctcccaaagtacaggcgtgagccactgtactcggcccagcttttccttttaagcttttcggtaggtctattcctttccccacctgttatccactgcctcaggaagctgcaaagttagtcagttgcctgcaattacaccctgatgaaaagacttttcacaccaggcaaaggctgaaccaagtcaattacagccaaccttgcaagaggagccttatcagggaaccaccagaccggtcagataatgacagttctttgggcatgagacttgaaaggagctccagcctcattctgctccctcttgtggcgccaggctgctgtttttcatcaggagtgcagaatgtgaattttcaaggccaccacggaactgcagagtgtgcgatcttaactagggcaagtgaaaatgccactgttcttaccaagattctgctgtttttcttgaataaacattctcccgactgccctaagcctctggctaatttccagagttctgaaaaagttgattctgaccatttttgccagttttctcactgctattatggaggagagaatttttggaggtccttacttcacggattttgctgatggcacacctggaaaactgatttttgtttgtttgtttctttgagacagagtctcgctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcactgtgttagccaggatggtcttgatctcttgacctcgtgatctgcctgcctcggcctcccaaagtgctgggattacaggcatgagccaccgtgcccagactttttttttttttttttgagacagggtcttgctctgtcacccaggctggagtacagtggtgtgatctcagctcactgccacctccgcctcctgggttcaagcgatcctcctgcctcagcctccccagaggctggtgcatgccaccacgcctggctaatttttgtatttttaatagaaacagagttttgtcatgttggccaggctgttctcaaactcctggcctcaagtgatccacccaccttgacctcccaaagtgctgggattacaggcgtgagccaccaagcccagcccaaactgcttttttttttttttaatctccagtgagatcagaagtcacctgcctgggttggctctgaatgtccctacctgctctgttcccctgaacctggagtcgccagacacccaacccatgactacacccaggccagtcttgaccctgggcgtaaaaagcattccccactcctctctgctctgtatgttcttatacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaagagccttgactcagtcattattcataacctctttcagtggtttttcatgccagctcataccagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcatgatctcagctcactgcaacatctgcctcccaggtgcgagtgattctcatgcctcagcctcctgagaagctgggattacaggtgcctgccaccacgcccagctaatttttttgtgtttttagtaaagatggggtttcatcatgttggccaggctggtcttgaactcctgaccacaagtgatccacctgcctcagcctcccaaagtgctgggattacaggtgtgagccaccaggcctggcctatttttattttttgagacagggtcttgctctgtcacccaggctggggtgtagtggcacgatcatggctcactgcagcctcaacctcccaggctcaagcaattctcccacctcagcctcccgagtagcaggcagcctcccgagtaacagcctcccgagtagcatgtgccaccatgcccagctaggttttaaattttttgtagagacggggtctcactatgttgcccaagctgctcttggattcctgggctcaagcaatccttttgcctcggcctcctaatgcgctaggattacaagcatgagccactgtgcttggctgagcaggcgtatctaagaaaacatatttctgggccagctgagttcagggaaaatgccttgaacttggagaaatactaagtcaaagcttacgagctaagtacttttgttattttacaaaacggcctttcctagaaacagctctgagtgacagggtgagccctcattgtgcattcatgggaaaatggaaacgaaatctaacaggacaaaggacagataacctttccatctttcttggcaaagcactaataacagatcacagtaaaggctaaagctcctctgtgagtttctttccaacagaggcagcagaggtacaaaggataagaggaaatgggctaatgtagcagagagattcacctaaatggagtctttccacgtgcttttccctacgttagggactcggctctcctctcgcctggctccctccatcctgaggctcatcttccatctcagctacctgtcacttcctccaggaggccttccctgaccaccctcatgtgttcccctgccactatgcctgtcctatccccagaggcttgcccagggccaagtgttgggtagggagtcaatgcctgggaggggctcaaggaactgaatgaagcttgcactctgggagtctctccagagagtctgtagaggctggtaggaaactcaggctgatttgaaccaagccctgattctagaaaaccacatacctgccaaaccagaagcagcagccccctctctcccctgctccctgccctaaggaaggaagcctgtgcccccttccactccttcttcatctccttcctcaccagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtacccaccagccagacactggagagaggagggaagggaggggcagtaactgttccctggttccccatcagaacccctggggacatttcctttaacacattttattttgagatggagtttcactcttgttgcccaggctggagtgcaatggcacgatcttggttcactgcaacctctgcctcccgggttcaagcaattctcctgcctcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacggaacagaatctaaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctaccccccaaaaaatacagcaaagagcatctttatacacagattgttgcacacatgcggggatatatctacagcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggacggtggggtgagggcggagaaggcaaaagccaggggaaatacagggcctcgaagtctcactgtcgcccctcctcccaccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaacccagcaccagcccagggaggccaccctcactgcagccatcctagacgtgtgtggcctttacaacaactttccagcagggggcagcagagcttctcgaagaaggacaccatagtcatcatggcaccaagtcatcttttggccagtggcccagctgaacacagagggcaatcttttgacagaacaattccagaaaagccctgttttgtggggaaggtcacgcccaggaccaacatcgggaggcctggactccaacccaggtcctggccctgcctggcacggggtccctaggctggtcacctgccttcctctggggaaggaagaggtactggagaggaaaatgaggtcaaagcaggctccttggaaaaccagagcacaagcatggtctcggtgttcagtcactgagaatgacaaagaaatatcaaagttcaggtcgggcagggtggctcacgcctgtaatcccagcactttgggaggccaagaatttaagaccagcctgggtacataatgagaccccccccaccgcccgcccagtctttaccaagaaagaaagaaagaaagagagggagagagagggaaagaaaaggaaagaaggaaggaaagaaggaaggaaggaaggaaggaaggaaggaaggaaggaaggaaggaaagaaggaaggaaggaaggaaggaaggaaggaaggaaggaaggaaggaaggaaggaaagaaggaaggaaggaaggaaggaaggaaggaaggaaggaaggaaggaaagaaggaaggaaagaaggaaggaaggaaggaaggaaggaaggaaggaaggaaggaaagaaggaaggaaggaaggaaggaaggaaggaaggaaggaaggaaggaaggaaagaaaaagaagaaaaatatcaatgtgaggcaaggcgccgtggctcacacctgtaatcccagcactttgggaggctgaggtggcaggatcacttgagcccagcagttcaagaccagcctggacaacatagcaagacactgtccctacataagaaaagaaaaaaagggccaggcacggtggctcacacctgtaatcccagcactttgggaggccaaggcgggcggatcacctgaggttgggagttcgaggccagcctgaccaatatggagaaaccccatctctactaaaaatacaaaattagctgggcgtggaggcgcacgcctgtaatcccagctactcgggaggctgaggcaggagaattgcttgaacctgggaggcgggggttgcggtgagccaagatcgcatcattgcactccagcctggacgacaagagcgaaactccatctcaaaaaaaaaacaaagaaaagaaaaacaggaaatatcagtttgagcatagtgcaaatgtgttagaggagggaagcttcctagaagcagtaaaggaagacttcctcgctagagtaagaagacaactttcccttgttgttggcttttggtttgggctgagtcttggtttacgtcttagtgcagcccaggcctggttcccccttgggggtgtcacttgtttgcttcggggtcatgggccatcattcctagggctttgggaggccctggcctcgaacatacctgggcaaccctagctcaaggctgagagatgaatgttgatggaaggaggagacaattccactgaccccctccccagaggacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagagtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccaggtttttgttttgttttgttgagacatcgttttgctctgttgcccatgctggagtgcagttgtgtaatctcagcttactgcaacatccacctcctgggctcaagcctcagcctcttgagcagctgggaccacaggcacatgccaccaagccaggctgattttttttttttttttgagacagagtctcactcttgcccaggctggagtgcagtgacatgatcttggctcgctgcaacctctgcctcccaggttcaagtgattctcgtgcctcaaccaccacacctggccatgttctgggtattttctagagattttatatttatcattttagtaattttctggtagaagaaaactgcataataaaacaatatgttttttaaaaaaataaaaataaaaaagctggggggccaggtgcagtggctcaggtctgtaatcccagcactttgggaagccgatgtgtgcagatcacttgagcttaggagtttgagaccagtctggacaacatagggagactccatctctacaaaaatacaaaaattagctgaccctggtggtgtgtgcttgtggtccctacgtgggaggctgaggtgggagtactgcttgagcccagaaggtcaaggatgcagtgagctgagatcgcactgctgcactccagcctgggcaatggagccagaacctgtctcgagaaataaataaataaactaggagttcttttttcttttcttttcttttttctttttcttttttcttttttttttttttttttttttttttgaggtagggccttgctctgtaggccaggctggagtgcagtggcatgatctcggctcactgcaacctctgcctaaaacctgggagttctataggggcaggttcaccagctgcagaggacatctgagcccgttgacaaaggccctcccctcagtgtgcccctcccctacctcactcagctgttctttccatttggaatgctgaggacacagcaccattgtaggctcaggccctgctggtggaggttgttcagtctagcccagaagttaagacagaacagtaaacaaggaagggcattgcgtgatggagggggtcatgctcagagacgcgaggggagcactggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcaccgactgccaggtaacttcctgagtgctggttggtcacctgctctgagttctcagggacaccagcctggacaatgctatgacaaatgtcactgtcttgccagggaaggctctgcccatcccatgagtgatctgggtgggccaccctgcatcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttgctccagccactccacaaagtgataagcttcaaacactcagttactaaaaataatggccatggcttaattttatttccttttttttttttttttttttttgagacagtctcgcttagttccccagactgagtgcagtggcgtgatctcggctcactgcagcctccacctcccaggttcaagagactctcctgcctcagcctcctgagtagctgggactacaagcacctgccaccatgcccaactaatttttgtatttttagtagagatgggattttgccacgttggccaggctggtcttgaactcctgacctcaggtgatctgcccacctcggcctcccaaagcgttgggattacaggtgtgagccaccgcgtctggctggcttaattttcataatcctcaaactatccccaggaggaggcagcattgctcttctcttcatctcatttttcatgttagggaactgggctacagaaaggccaagccacttgctcctgctctcccagctagtgaggagccgagattgggtgtgaaccaaggaagcttggctgggaaatgcgggtgccttggcacaattcagcagtgaggcatagcctgtcttgctcagtgccactcctctgaggagagcaacagacagggagcttgagacagagctatgagcacaatggttagaccagagaagcttagactatcacatccccctccattcttcttagggcccatttaccttgtctaaaagtgccctttctcctcctccccttcatctcctaaattaggtaataagcccgaattctaaccacccccttgagtcattcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgagatctcggctcactgcaacctccacctcccgagttcatgcgattctcctgccttatcctcctgagtagctgggattacaggcgcacgccagcacacccagctaatttttgtatttttagtatagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtttgctaaggagcaaccccaggcttgtgactcagccagtccttgctttgggagcagaaacctggttcgatgtcctcattctacaggggtgggaacgctggctgacaagggcagtgcattgttccaggcctcatagcaagtagggggttcccagtagatgtgaagccctttacaggctttaggagccttcccaatgtcttcaggtcctgcaggctgccagggctgtgtgaaaggagcagggtgtcgagcacagcacccataggcctttcgcagggctggttcctagagggacttggtggacctgtgtcgtagaacctgggtctcccttgtcctcctcctgcataaggttaaacaaatttagcaaataagaatatttgaccctgggccaggtgcagtgggctaatgcctgtaatcccagcactttgggaggctgaggcgggaggatcacttgaggtcaggagttcaagacgagcctggccaatatggtgaatccccatctctaataaaaatacaaaaaatcagctgggcttggtggctaacgcctgtaatcccagcactttgggaggccgaggcgggtggatcacctgagatcaggagttcaagaccagccgagattgcgccactgcactccagcctgggcgacagagtgagactccgtctcaaaaaaaaataatatttggcacttagttaaatctgaattttaaaaaaaaaaactattttttttttagtataagtatgtcccatgcaatatttggtatatacttatactaaaaattattcattgtccaaaaatctccagatgtttctttttttggggggatgaagtctctttgttgcccaggctggagtgcagtggcacgatcttggctcactacaaccttcacctcctgggttcaagcaattcttctgcctcagcctcctgagtagctgggattacaggcgcccaccaacacccctggataatttttttatttttagtagaggcagggttctgccatgttggccaggctgatctcaaactcctgacctcaggtgatccaccattctcggcctcccaaagtcctgggatgacaggcatgagccaccgcgcccggcccagatcctttctttagtcttgatcatttctcccactgtggtctggctgtcaacacactaggtttgcaaaggtgactgggaagtgtagtctgccttgctcaccaggggcccagctacaactatattgcaatggaggaagggagaggaggtctgggtgaaaatctgaaggctgcactgtgtgtgtgtcccttttaaaaaaatgttccgtcttcactgaagaaactcttgaaaacccagatgaaaccaagtaggaagtgacactctccttatctcagcggtagcagcttttctgggcatgtccttcctctgactcccatccgtgagtcccagggctgggaccaggtccagcaacacgtgcctgctgcctggagttagcagcagagaaatgccagtggccagcccacgggaaggactgtgcccagagccctttctttattttatttgagacagggtctcactacgttgcccaggctggagtacagtggcacaaacatggctcactgcagcctcgacctcctgggctcaagcgatcctcccatctcagcctcccgaggagctgggaccacaggtgctcaccaccacacccggctaatttttttattttttgtagaaacagggtctttccatgttgtccaggctggtctcaaaatcctggcttcaagcgatcttcctgccttggcctcccaaagtgctgggattacaggcacatgaccagcccagagccctttaaagaacagcctgtcagacacctgaggtcaagagtttgagagcagcctggccaacatggtgaaaccccatctctagcaaaaataaaatattagctgggtgtggtgacgggcgccagtaatcccagttactcgggaggctgagacaggagaattgcttgaacccaggaggcagagattgcagtgagccgacatcgtaccactgcactccagcctgggcaacagagcaagagtgtctcaaaaaaaaaaaaaaaaaaagcaacctgtgagctgtggatgagtgaggtcagcacagctagaagtcagacacaaggaagaacttcctacctagcaagactctgagatcctggagcccagaagggaccaagtgagccaagctgtggctcagaagcctctgtccctccaaccatgatgtggtctacctcccacaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgtttgaatagggccaagtggctgagcctccccaggggccagttaatcagacacacataactttgctcctctctcctctacctgggtctgcccggccccttcaataggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccgtaagcaccgggtgcctggggaaaatccctccagcacgtcccgacctggccccacagcagagcaggctagtcagacaaatagatggccccgccctcccacccccagaacataggtgcacattttgggggaagcagtgtgggctccataaataggtgttggtgtgtccatttgcctttgctcaactgctgggtagctaagtggccttcagtaagtcacgtcactctccaggattcagttttttacctgtaaatcaaagaggttcgacttggtcagtttgtctagtttcaaataacacttttttttttttgtggaaactttccaatgaaggcttagtattgtattatattatattgtattttaatttaattatttttatttatttatttatttttgagacaaagtcacgctctgttgcccaggctggagtgcaatggtgagatctaggctcactgcaatctctgcttcccaggttcaagtgattctcctgcctcagcctcctgagtacctgggattacaagtgcataccaccacgcccagctaatttttgtatttttaatagagacaggatctcaccatactggccaggctggtcttgaactcttgaccttaagatgatctgcccaccctggcctccgaaagtgctgggattataggcgtgagccaccgtgcccagcctaattattttatttatttttattttatcagtttattttattttacttcattttgagacagggtcttgctttgttgcccaggctggagtgcagtggcacaatcatggcccactgcagcctctacctcccaggctgaatcggtcctcccacctcagcctcctgagttgctgggaccacaggcatgcaccaccatgcctggctcattttttaatttttgtagagacagggtctccttatgttgcccaggctggtctgaaactccagggctcaagcaatccttccacctcagcctcccaaactgctgggattataggcatgagccaccacgcccagcctgaagacttagtagaatgctaatagggaagccagatagaaggggacttgaagagggggactgagatccattcctacatcctttccccagtggacagccctgcaggcaaccccccagaaccatggggaacactgtggaactgaaaacccctagtgctagggccgggtgtggtggctcacgcctgtaatcccagcactttgggaggccgaggcgggcagatcacctgaggtcgggagttcgagaccagcctgaccaacatgaagaaacctcgtctctactaaaaatagaaaattagccaggcatggcgtcacatgcctgtaatcccagctccttgagaggctgaggcaggagaattgcttgaacgtgggaagcagaggttgtggtgagccgagatcgtgccattgcattccagcctgggcaacaagagtgaaactctgtctcaaaaacaaaacaaaacaaaaaaggaaaacccctagtgctgaggcctggagagcctcctggctctgcctgagactgggatctcaccattgagctggtccttgttgggccaaagccgccatatttcatagctccaaagggcgctcttctgcctgtggttctggaactccatgctccttggcattgagtaactcagtgtccctgctgcagccttccaaccccaatattcagccctccttccttgacaccagccctgggtacagacctctacagtacagggactgtatggagagcaaggagagctcagcagaagccccacctggccccagcactggagtcgcttgccatcctgccctctccccaccgggctctctctgtccctgggtgcccagatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctgtaggggcctggacaggggttgggtgggttggggactgggcgggacacatggcacttgggttctgcttctgcttgccgacttcctgggtgaccttgagcaagtagtcttacctgctagatcttaatttattcacctggcaagtgggaagaattattcccttccttccaaagcatcccaagtctccaaacagacttcaggctccttacaggcaggaaccatactccatgcctcctggtatcctcccctccccccagagagggcacatggtgaaaatgcgtgttgagtgactgaacgagggaacatgtgtgttgagtgactgaacgagggtcctagaggtaagtgagctgtcagagaggaatgggccttgagacccctggagggaagggctgggacattagcggtgtgcacgtcatgctggcttacccaggtttggtgtcaggagtgtgacctgtggtcagctcatctgcccatggccccagctctaaagcactttctagctgtatcacctgagctggtcgcttcacttctggcttccttcatttccatctggaaaatgaggagatgttgctataaagatggtgtctggtcatcttccaggccctcttttgtaccagcggagagaggaagaaaagacattgcctgtctgggtcacctccttcaggccccacagataagatgccaagatatgaaagagccaaagagcagcgtggaagggaaaagaaacagcgggtatatgccaggatttacccttgtaggcaagactggctgcagacttggggattgcaggcactgcaaaatgaaaatgtgagggccctcgtttaaaaagtattaataattttaaaacagtgacaatagagcgttaaaccaagcgtgggccctgctgagacagggtccagtgtatctgcacagagcacccacccatgacgcctgcttgaagaagagctgtatggcaagttcttggtccctgatagagtggacagagcgaaggatggtgcatgagcacacagggaagataactggttccatcttgtgatttcttccctcttctgcctccctccccctgggtctaaagctgtgatttccacaggtgcattttgcatttgggggtacttggttatgagatgttttcttctcacactgggtaatacaggtggggcagagagctccctccacttctggtggaggcaaaactagaatcctggattctgacgcctaatccagggctcctcccactcaccactcctggcctatccagccctgcagaaggcaaagatgacactggccaccttttacaacgcaatggtggctggtaggcaccatgctttgtgacatatgtcccaaaacgtgctcctcaccatggcttgaacattctacatgaagaagttgagccttggaaggggttcaggttcacagaacttggccccttcctcctcctgcctgccacacacttcctgtctctctcttagtctgcaattggcccaaaacgctggtggtcacaaagtaccgcgtggtactgaagctgttttacataggctgggtccttatgcccactatttctaatcctggccacagccctgcaaggtgtcctgtcctctctatgggtgagggggccaaggagactcaggaggagctagcccgaggcctcccagtctgcatgtggcagaagccaggcgtgaacccaagtctgccagattcccccagctctgcccactttccgcactgtctgggccctcaccagccgcagagctggcacccgggttccagggtgctcagcgacccaggcttcagccatttggctgctttggtcctcgtggggttcacatcccaggggagtggggaaggcctgtcccctaccaacaccaacacttctgtgctgtcttcccctgcagcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttggtattgccccgctctcacaagtgggaggctgagctccgccttaaagcagcactgggtggtgggctgggagcatcgggccctgactccccagcccctacaaatcactagcccccactgactcactgggcactgagtcctgagccaccccttggagagagggaaggggcggggcttgtcccggagctggctgccccattgtctcagccaccctgagcccaccccaaggccgaggccaccttagtcctagtcctggatgtctcctgggattcagcttctcacaggctccccagcaatcattttcgtttgtaaccttgcagaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccacgagttagtacgtgtgatgcatcctgcacccagagcctgtcacgttatctcgtgtaactcattcacgacatccctggaactgtgtgctcccatcacctttatactacacaggaggttccaggagcggtacagggacgtgcccaagtctcagaactcgtgacggggcacagcggggacgggagcccaggcagctcattcctgaccctgcacggtcatcaactgtgggccaggtgctgtgcaggcctctcggggactccagggtgggaagtgggctgccctgggggtgccctgaaaccgcagctcaacagagcagtcagtgaccattaccagagacattgggaggtcgagagggcacttcagtgccaaccttgcacaaggaacaatgccctgaccatcatcatcctgtggatggcaggtgaccttggcagggacccaaagtgcccttgaaaaatgcccttgaaaaatgtgttggtcaggtttcgtggctcacgcctgtaatctgagcactttgggaggccaagacaggaggatcacttgagcccaggagtcaaggaggatcacctgagaccagcttggacagcatagtgagacccccatctctaatttagaaaaagaaagaaaaatggccatgttaagaatctccttggctgggtgcagtggctcacacctgtaatcccagtactttgggaggccaaggtgggaggatcacttaagcccaggagttcgagaccagtgtgggcaacatggggaaaccccatctctataaaaaatacaaaaattagcctggtgtggtggcgcaccactgtaattccagctactcaggaggctgaggtgggaagatgacttgagcccaggagctcgagactacggtgagccacaatcgcaccactgccctccagcctgggcaacggagcaaggccctgtcttgaaaacaaaataaaatggccaggcgcggtggctcacgcctgtaatcccagcactttgggaggctgaggcgggtatatcacctgaggtcaggagttcaagactagcctggccaaaatggtgaaaccctgtctctactaaaaatacaaaaaacttagccaggtttaatggcacatgcctgtagccccagctactcgggaggctgaggcaggaggatcacttgaacctgggaggcagaggctgcagtgagccgagatcatgccattgcactccagcctgggcgataagagtgaaactccatctcaaaaataaataaataaaataaaataatctccttgaggagggacccagggccagctgccccccgtactcaaagagaaaaatggagctgtcgactgtggttaaccttgataaaaacaataattcaggttatgctgagtgcttgatcttcacaagtgccccaggagtgatctcacatttcaatccccacgttatggatgtagcaggcgagagagagagagggagtaacttgctgagtccagtgggagtgggtagcagagctgagacttcagcccagagtcacagccctacagcttacgccatgcacactgcactcccaggacccgggtaagaggagtgggctgggccattccagcatcagacggagggggccacgagggagcagcaggcccctcgctgagcagggacacacacagcctcagtgccgtcctcaggaacgccctgcctagagcagcgattctctactggggaagattttgcccccaacaggacatctgtcaatgtctggggacaaccggtgaggagagtgcttctggcattgagtgggtagagacagggaccctgctcagcatcctgcacacaggacagccccctacattttggacagtggagtcatgctagagaggcccaatttagagaaaaatctacccaaatggagcatcccaagagaaagtacaggctctgcacacactaacctgagcacaccgaaggcccctgtgagaggctggcaccatgagctcgaaggcaggaggaccttctttcactgaactggaattttgacctttggcttgtgcctgcaaaaggaggctgcctgatggaatcagcaggtcccttgtgggtgcagagaacgccactgggcagggacagcatttgaagaggcatttgaggagtggccgtggaagaggaaaggagagccccacagacggcacccggcaaagggcagcacgagctcagcgggtgcggtgccaatgctgccaacccgtacgatgaccttcactgacctctcacgctggcctcaccaggaatctgttgtttagtcccttcctaagaggaggcaaaccaaaccacgaggcatcactggggcgccagaggtgcctggaaaaacccaccccgtgggtgtggactgtgcactgggaccacgctggagccggtttgggaagtgcggaagcagcggccggactcaagtgtccacagcacagtgacgtccttcctgtccgtgccacccggaaaagggggtgcttccttggcctcttttgctcagctgacttaatgaatgcaccgcttaaccaaagatgcttccactgtgaccacaacagcccagtggctcttgggagaatcactgtcccctttccccaccgtgtggctgctggggactgtaggccccaaggcaggactctgaggagggaccccctgccctttataagtaacaaaattaagtgtttcccgggtcccagaggcccctgagatgttactgatgcccaagtaggaggcaaaggtgactgctggcctgacgcagtggctcacacatataatctcagcactttggaaggccaaggcaggaggatcacttgagcctaggagttcaagaccagcctgggcaaactaaggagacctcatctttattatgtatatgtatgtatgtatatatatatatataattttttttttttttgcaacggagtttccctcttgttgtccaggctggagtgcaatggcatgatctcagctcactgcaacctctgcctcccaggttcaagtgattctcctgcctcagcctctcaagtagctgggactacagatgccagccaccacgcctggctaattttgtattattagtagagacggggtttcaccatgttggccaggctggtctcaaactcctgacctcaagtgatccacccgcctaggcctcccaaagtgctgggattacaggcatgagccgtcgtgctcggcctattaaaaacttttttaagtgactactgatggcctaccagggtcagcatccagagaccccccagccagcctctctgtgtgctgacgtcctggggacgcctgcagcactggtgggaagtgtagatagaggcagtgttttcacggcatttccaggcagggaagtctgaacccagctcaggcgcttgccatccgggtaacgttgcctacactcagccctgtgccaggcacttgccatgagtggagaataaaccagatgcaggccccgcctcccagagccggtacaccagtgggaggcagggaaagctgatagataggcagatacctacagaacgacagttgtgcaaagtgcatgttaaggaagagtacagggtgccgtgagagggataacaggaagaactaacctagactctagagaagaaggagctggccaggaggcctccatgagaaagggacaatgcagctgagaccttaagaacaagcatgagcagagatgtgtgtacacgtgcgagtgcatctgtgtgcatgtgtgatgacgtgcgcatctgtgtggaggggcaccccaggcagggcagctgcacacacaattccggaaggaggaaagaagccggtgctgctctgttagaccaacagggagtcatcagtgtgaccggagtgagtaagggctagagcctggaaccagccagcgacagcaagagtctgctggggcaggtcttgatgtcaaggattttgaccttgctccaaagatcactgagaagcacgggtgcggcttgatgaagcctttgctggtggagggaggcctggagggaggcacctgggggtcggttgggagcacattgtggtgtcaggcaaaagagatggcagcttggagtggggcgatggccacgaaattacttacctctctgcacctctgctatctaccttcaggaattgtttgggtgagtaaatgaaataacacactagccactgggttcaaaataagtgctcaataaacgcctatcacctccctcacttagaagcatctgacgaccacctgggacaggcctcatggctggtggcaagttctaggttagtacaaggagctactagaatgacttgtgaatttgtttcttggggtcctttcagcatctgcaccccaaatttggaagaggatgctggggcttaagagaaaagtcctcaatccatgctttgttttcccaataactctcttccatttcccctcccaagtcgtacctccaggagccaagcctgggagtagccatgcccagaacacaaggaggtgggactttgcccaggttgccctagagctctagagggccaacgggctttagaaagggcttatcaaaaccagtggcttccaactacaggtgggtttggggggaaatggagaatgtcatatatctctgattgaaaaaatcaggccgggcacggtggctgacacctgtaatcctaacactttgggaagccgaggtgggcggatcacctgaggtcaggagttcgagaccaacctggccaaaatggtgaaaccctgtctgtactaaaaatacaaaaattagttggccgtgatggcacatgcctttaatcccagatactcgggaggctgaggcaggtgaattgcttgaacccaggaggcagaggttgcagtgagccgagatcgcaccattgttctccagcctggatgacagagcaagactccgtctcaaaaaaaaaaaaaaaaatcattgctacttggagatggtcaccgatgccatctacacttgctttggcagcaacagccttcttattaagcaagagaagttttgcccattggagggctcacttcaggcaactcaatgaagatttcaatgagctcacaaaagcctgagcccaggtaggtttttagtaacctttaatgtatgcggtttgaccatgaacaggagttcctcagcatccctgagtcttaggaccctcataggtaaacaaaagattctagtgaagattaaccatgacaacacagattcagcacctaaagtggctaccagcagattgcaggtgcatactaaaccttagtttcctgggctgaggtgaagctgaagcggtaagtccccctttctttctttctttctctctctctttctctctctctctctctttctctctctctctctctttctctctttcttctttttttttttttttgacacagtcacgctctgttgcccaggctggagtgcagtggcacgatcataattcacttgcagcctcaacctcctgaactcaagtgatcctcccacctcagcctcctgagtagctgggactagcggtgtgcaccatcatgcctgacttccttatttatttatttatttatagagacagcagggtggtgggaacaggggcggtctccctatggtgcccaggctagtctcgaactctgagctcaagagatctttctgcctcggcctcccaaagtgttgggattataagcatgagccatcacatctggcctaaatcccttttctgatgagatgtcggctgtttccaaggatcttaaatgtctgcacgtgggtctaaatcaaatgctcctgctgtgtgtgggcaggtttgctcaagtagattttctcactcattcattgactaaactctcactagatactgtactggaaatatgaagttaagagccagcttggccggaggcaggtggctcacgtctataatcccagcactttgggaggccgaggcaggcagatcacttgaggccaggagtttgagaccagcctggccaacacagtgaaaccctgtccctactaaaaatagaaagaattagctgggcatggtggcgcatgcctgtaatcccggctactcgggaggctgggacatgagaatcacttgaatccaggaggcagaggtggtggtgagctgggacagtaccactgcactccagcctgggcgacagagccagcccctcagctcagacaaacggacagatggttctgatctccagttgtgagtgctgttacagagaagtatatagaaaaaaggacctgggccgagcgccgtggctcatgcctgtaataccaacactttgggaggctgaggcgggtggatctcttgaagccaggagtttgagaccagcctggccaacatgacgaaaccccatctctattaaaaatacaaaaattagccagcgtggtggcgccttcccgtaatcccagctcctcaagtggcagaggcataataagaattgcttgaacctgggaggcagaggttacaatgagctgagatcacgccactgcactccggcctgagtgacaaagcaagacagaggagagagagaggggcagagagagagagaccgatctaatccagtgggatgcaggctggcacccctgtatttgtcaggactcttggtcacatgtttaagaaacccattctagctaaagccaagaaagaatatttgttggctcaagaaacttggaagaccaaggctaacagcttcaggtgttgctggatctagcaactcagatgttgtcatttggtatctctctgcacagcttctttctttgcctcagttttatgaacttctgctttagtgaagctgctttcattggataaggggagggattagatatgaccccaccccccgattttagtcatttcagccagtaatcccaaaggcaggagagagctcctccctcccagtataacaaaattccagggaaaggctctgattggcctaatgtgggtcatagcccatccccttggaccaatcactgtgaccacagtcaagtctgggttgcatgccttctgccatggctgggagtggaacaggatgctgtgatgggctccatcagaatgacatggactagagaagaggcagttcccccaaggaaaggggaggtgacacataagatgagcttggaagaaggagttagccagatagataagtggaaatggaactccaggacagagtggcaggaacaaagcccagagaggagagaagagctgctcacgcagaggactgcacttggttgagcacggccagagcaagggtggtagaaggggacgagccaagaagaggcagggaaggctgcaactacaggctaaagagccgaccccaaacagaaggcaatggggcaccatggcaggatttcaagtaaggtcacgacacccatctgtcctagagcagtgagggaatggagtcaaactggaggcaaagagaccacgcagtgtacgtggtcatccagatgagaaactgaagtcccaggctgcaggcagcagtgatgggagtggagaggagggacagaaacgggttccagggcaggaccaggatgcagagcgcatggactgagcatacatcaagtgcctgggtctctgcccgtgcagggcttactttgattcaggctctgtcagggcataatgagagttctgtggaccaggagaggaggggtctgatatggaggatgacgagaaatttgacagaggtaagctggaaagggtgtaccaggttggaggactggcatgagcaaaggccccagtgtaggacctggctctagcatacatttgggaataagcaagtggtgaaggtgagtggaaggccgagcccacagagcagaatgagtttaaatgaagccgggcaggaggctgaaaggggttgtggagagtaaagtgtctgcctttacttctgtgttagagaacacaggaggtctctgcctgtcagatcgctcccctttcaaagatctctgcctgacagatctcttcccctttcaaaagtggggctggggccaggcacggtggctcacacctgtaatcccagcactttgggaggccaaggcaggtggatcacctgaggtccggagttcgagaccaacctggccaacatggtgaaacctcgtctctactaaaaatacaaaaattagtcaggcgtgatggtgggtgcttgtaatcccagctacttgggaggctgaggcaggagaatcgcttgaatccggaaggcggagattacagtgaaccaagattgcgccattgcactccagcctgagcgacagagctagacttcatctcaaaaaacaaacaaataacaacaacaaaaacggtggggccagggcatagcaagaggccatgacatggtccaggtgagaaggggtaaaaactggagcccagggaatggcaagagacgatgaagagaagaaatatttgcagaagtagaatctgcaggagttgaatgtagaagatgagaaaaaaagatgcggtaaaaaatgccttaaaggcaatgggtataaaggggatggtgggccgggcgcggtggctcacacctagaatcccagcactttgggaggctgaggcgggtggaccatgaggtcaggagatcgagaccattctggctaacacggtgaaaccccgtctctaccaaaaatacaaaaaattagccgggcgtggtggcgggcgcctgtagtcccagctactcgggaggctgaggcaggagaatggcgtgaacccgcgaggcggagcttgcagtgagccaagatcgcaccactgcactccagcctgggcgaaagagcaagactccgtctcaaaataaataaataaataaaataaaataaaggggatggtggtttaattgacaaaacccaaaagtcaggcagaggacattgtttgagaatatacctgactttgtgatgagtcttcgtgtaagatgggtggggacttgttacttaggagcttcttatttatttatgtatttatttatttattcttgagatggagtctcactctgacgcccagactggagtgcaatggcacgatctcagctcactgcaacctctgtcacctgggctcaagcaattctcctgcctcggcctcccgagtaggtgggattacaggtgcctgccaccatgcctggctaatttttgtatttttagtagagacggggtttcaccatttggacaggctggtcttgaactcctgacctcaactgatctgcccgcctttgcctcccaaactgctgggattacaggcatgagccactgcgcccagccaagaagcttcttatttttacccatcaatcgctataggcccagcgcagtggctcacatttgtaatcccagcactttgggagtctgaggcaggaggattgcttgagctcaggagtttgagaccctgcctctacaacaattaaaaaaaaaaaatgagccaggcgtgatggcatgcgcctgttgtcccagctactcccaaggctgagttaggagaatcgcttgagcccaggaggttgaggctacagtgagctgtgatggcaccactgcactctagcctgggccacagagtgagaccctgtcttgaggggtggggaggcagaagaaaaaaaaagagaaagagagaaagaccttgtctcaaaaatacaaaaacaaaaacaaaaaacaccccacaaaaacaaaaataactatggggcattctgggtgggactgatgcatgtggaggaacagaaaagaaaaagaaaaatagtgacagcccagttgaccaggggcctgtttgattgatccaaataggttcttttcaggagcctaaaatgcaagcacaacacacccctaaaacttacccgattctctttcgagaggctgaggtgggaggattgcttgagtccaggagttcaaaaccagcctggacagcacagtgagatccctgtctctacaaaatacaaaatgttagccaggcgtggtggtgcgcacctgtagtctcaactacttgtgaggctgaggcaggaggatcacttgagcctgagggattgaggctgcagtgagccatccatgatcgtgccattgtgcttctgcactccggcctgggtgacagagtgaaactctgtcataaaaaaacagaaacaaaaacaaaaaacccgacccgattcttgtcacagtatgcccatttgcaaactgtccagcctacagcctaggccaaggaacaggacaaaacctgggatcccgggcaggagagtttggtttccaccaagttttacttggtttatctatttattaaacccaaggctgacggctgcttcttgctgctgtttattaataacgattcccaacacaggctcctcaggggcagccggggaagccagtcccagggcacaggctggcatcacactctgcctctgagggaccccaggcagtctgaggcagccctggggacatgagtgcttcctttcccagccccttccctggaaagtgaaacccatcgtggcttcctctcccagtcttggggctgccgggctcagcttcggtgggggcagaggacacagaggatggacatcagaattgggagaggctccaacatcccccaggaaactgaggccccagggaggcaggaaaaaccagctccaggtggctggccgagttggaggcggaactgggaccagaatccaagttttcccagggcctcctgaggacaggaacctttcccctgtgttccctgggagtgcaaccgttgttattgtcgccaagaatggaggcggtagcgtcagacctagactttcttgcacagtattgtggctcttccagcagcaggcggggagccagcagggcacacggacccagccatcgtgacctagattctgggttcaggggtagagacttgtttgctagtgggtcgcactgagtcaggctcttctgtagcacaccccaggtaacagaggtgctgggcggcctgagcaaagggacaactttttgccacccatgccagtgggcagtgggtgcagacactcacagcacaggcacctgctgcgatgcacgcggcgcccacggaaacccgaggctgccagccgccgccctggagaccccagagacagcggcagatgcgtgtgcttcaaggggcagcgtggctgctggggcgctccctaaagggcagtggcacggggtcgcgccgcgagcagaggggcgcgggtgggcgcgcaggagttagcgaactgacacggaggcgccaggcggacgcacggacgcaccgagggccgcagggccgcacagccgggcacacatcgtcgcgcagcggttcaggctcgggggcctcctcggcggaggcggccaactctcaccctcagcgcggggaggggcgggcgccgggggcggggcggcgccgtccgggccctccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccccgctccgtggtctacttcagtcggcctccagcgacagagtcctgtcccctcgccgccaccccactgagaggacaggcaacgaccagggccgggactcttcagagcaactttccccaagtcctgcaggatgggtgtcaagaagggaccatggcctttttagactttcctgagcctgaaaattaccccaacttcaaccccacccccacctttccaccctcccattgggagatcccgcccccaaagcgtgcgcagatgaatctcggctctctcatccagaaacgccaggggcagggagggcttgacctaactgcccccagaaggagggtggcggtttcccagttaatcagaggctgctccagccctggtgaggtcaggagtttaaagggatgtgggggtcaccagtaggaagacaagggcccctggtgtcaggatggggcccggagtgcctggttcttgggctgcaacacggatgctgcccaagtccggattcgaagtagttcagagaagtgctagatgcagctaccatggccccacagagccctggggcctgggacagatggggaggtgagagtgggggctgtggaggggaaggtggaattcctgatcatcagtggtgcctgggccagagcaacaagggagatgactcagtgacctcgaggccaccactaggctgtgggtgggtgggtgtctctctcagcaagccccttcctcatcccctaatttttgaggtctggggaagggccctcatcaccagaaggtgggcagtaaggtaactggaggataatgttgctcccagagtcccctacctctcaagggtgggcttgcttctctgaaaggagcctcagctccagcccccaagcaagccctgggctctaggacatcctctctggctttttagaatgtgtctctttgaaaatcactggccttggcatgtattgtgtgccccggggagcagggatgaagggtcctcccctcccgccagtggaatttggctgaagatgccactaaaggtgacccgtcaggtagtgtagttccctctgaaagtgccttttgttttgttttgttttgtttttcttttttgagacggagtttcactttctcacccaggctggagtgaagtggtgcgatctcagctcactgcccctcaagttcaagcgattctcctgcttcagcctcccgagtagctgggataacaggcatgcaccaccacgcccagctaatttttgtatttttagtagagacggtgtttcgccgtgttggccaggctggtctcgaactcctgacctcaggatccgcccacctcggcctcctaaagtgctgggattacaggcgtgagccaccacgccaggcctgaaggagtcttcactcggccagagggccgttcattctatccccacacccagcagctgttgccctttgatcagcacaagacgtgctccccactccaccctgttctttagggagatccacgcacaggatgagacccatttcacactggctggaggacaggcagatgggggtgggcgctctaggtgacactctcctcggtgtaggaatgtggtcacaggctgttgggatgatgggggacattccctgctccatcccacctaccaggcctcatcccagagccgtgcctgcaccttcctctgcagcacgtcattcgcggaaacacagagaggctgctccagtgccagggccccaagttcaagcccaggggagctgcgagtgttttatttgggcgtgaggctgaggcaggctggaggagcagacagctctctcccctggggctctcccggaggccagggctcctggggagactcatcaactcagacacagtccaacactctgtggacctgctgccctctgacctaggtagagttttacttaggacaagggaggcctgagatggctgaatgctagagaagccaggggcttgcttgaggtctctctgaggcccagcatggtcctctccctctaatcccaggggcttggttttccctcccaggtggcgcttcgggtccggcccatcagcgtggcagagctggaggaaggagctaccctcatcgcccataaagtggatgagcaggtatgcagggctctgcagcaggagctgcagggcagaggtctgctcagatggctcagctcacctggtgagggcagaaagggcccctgtggcttgcagcaccctccttcctctactcactgaactcttggctgtgctgttgatgacatcaccaaggaagctgggggctcttcttccaggaagccttcctagattgatccaaggacaactgggagcttccctagcctgggtgggccctgatcctttacctttcacatgctcattgcttgactttcccaccctaatatgcctgctgcccacagagcacatatatatatggttgagagctaaagctcgcctctagggtgtaacgtgtggcaaaatcctcgctctctgtttgcaatcttggtcctcatgtcaccaggatgaggaaggcagggcacacgaggcaataagtgtgtatcaagtaccagcagcatgctgggtactgttctagaaactgggaaactgtggtgaacagaaaaggccctgtcctctctccattaccttaagtctagtgtgaagagatgaggcattcatcaaagaattgcatcacaaacaaacgagtttgcagctaacaagggcttcaaagaaatgcttagtggcatgagagtaggtaagaaggggataagacctaaacctggaggtcagcgagggcttccttaagaaactgtgcttgacactttgggaggccgaggaggccagatcacgaggtcaagagatcaagaccatcctggccaacatggtgaaacccagtctctactgaaaatacaaaaatttagctgggcgtggtggcacgtgcctgtagtcgcagctactcaggaagctgaggcaggataatcgcttaaacccaggaagtggaggttgcagtgagccgacatcacgccattgcactccagcctgggtgacagagtgggactctgtctcaaaaaaaaagagaaaaagagaaaaaaaaaaaaaaactgtgcttgagctgaaaacataaggggtgaagaagaggtcattagtagcatgcatgaggggagaaatgttgacctgaggggcttgcatgtgcaaagggcctgtggtgagagggactgggatgcaactgggtagctgagaaaaggccagagtggctcaagcaggagagtaaggggcaagaggtgtgaatgggctgggccaaaccacatactctgtagaccatggccaggatgtttgtttgggtaggcagttgaggactcgtgctgggatgtacacaggcacagtggtgggggcaacaggagtgggcttggtgcccaggtaggagcatcgtggtggtaggatgtgctaatggctcagagaagttgggtggcactgtacaatgcagagaaaggcacacgtgagcacctgatgggcctgggctcaggtcccacgggctggactcatgaagccctgggcccaggataagcaaaccagaggcagatggcacacttccaatgcctgtttacctctgggctccccaggggcaggggcccactcaagcctctttcttcagcagtgatgatggaactgtgggcacagtagagccatgggtagcagcatcctcatttctttgcccatattccttcttggaaaagggtgggcttcctcaaagaccttggggaaagcaggggatgactgggaagacctcgtctaaatgggtcagacccagctggagcagaatgaatgcacataaacagtggttcgaggaggttctgccatttgccagctgtgcagcctggggggttgcttccaggagcttcagttgcctcatgtgtaagtggagacagacatcatgatgccttctttagagggtctttgtaggctaatgtacgcacatgcttacccagtccttggcacataggaagagtttcatagatgtcagttatcaacgtctgctagagactgaaattccccagggctgctgggttggctcaggagaggagccatagagttcaggaggagaaacctccttccaggcaaagccactctgtttgtccaacttgtcccgaagacatcaggtcctcggggttgggacaatgctgactctctctctgctactcctggctcctggcctgcgtgggggctgataaatattaactggtgctgatgggaacgctccctgtcaaggggacagcccattgtgtgcccacacacggcaaacactggttcctttctatccctgcgtgtggagcaggaggggctccctctctgggtctggcctaatccagccaagatacgcctccactgcctccacctccaagaaggcctctgagctgggtggttctaacagggctgctcctttgtcagctggaggtgcggagagtcttgtctgggctggcactgaggagagctctccatgcaaactccctgtgggcttctggccctaagctccttctgtccccagtgggttcaaagtttggcttgcaccagggatccagcccagcccttctaacggaggactgtagtttaggagcagccataactgccaggctgggacccttctagtaacaaacactgtccctctgacaaataaatgcctggcaagtaggagacaagatacatgaacccaggaagcaaaatgcacatggacccccccttacccttgtccccgacctgaccagttcccccacctcctgaccttcacctgaccctagtgaccccatagctcgctcacagccctggcccagagggaggcttgggggtccagtcctcgtcagcttctctgatggggccagctggcccgtcaaagctctgtccttcctcctaaggcctggaggcaccatggacaggtgggtgtatttgggagctgagccaggacatgttcgtcctgagtggggagaggtggaccggggacacagtaacccgctgggctgggccaccgtgaggggtcctggggcagctttctttagtctaggcattgttctcctggggacacttcaaatgaaggagattgtggcaacgaggcttggcagaaggggacattcccacaggcggagagtcctctgggacaggaacccagggtgcttggattctggggaagctggagttcggatttggatttttttttttttcttgtgatggagtcttgctctgtcacctaggctggagtacagtggtgcaatcttggctcactgcaacctccgcctcctggattcaagcgattctcctgcctcagcctcccatgtagctgggattacgggcgcgcgccaccgtgcccagctaatttttgtaattttagtagagacagggttttgctatggtggccaggctggtctcgaactcctgacctcaagtgatacacccgcctcagcctcccaaactgttgggattacaggtgtgagccactgtgcccagccggtttggatttttaatggggatagtccagttgccttggaaggccagtgattccaggaccccgttcaattccattagtagtcacaatgccttctttagagggtccctgtggctaacggaggcacagtgcataacacagtgcctggcatgtgtcttcacaggggttaataaatgtgaatgtgtctcaagggctgaaatatgggatggcttcgggtcccagaggtaaacaaaacctggcccttgagccttcctgctccctcttcctgtgtcagagcactcaggacggttcccaaatgaacacctcagtgtgtgtgtgtgtgtgtgtgtgtgtgtgtttgtgtgtgtgtgtgtgtgtgtgtgtgtgtgtgtgttcctggaagtaaggtgggagctccatgtcttagtagctcctggggtgagatcagaccctaacgtgtaaacacaggaagcggggaagtaccaggtgggcctggtttaatttacctctggggccccagaggagccagggacagcctgagaggctggtggggcctcagcgttccaggtgggggaaaaagctacagatcaaacagccgtctcctccaatcccccatccctcccaaagcctgcagcccacagaccctcctcctagctctcccaggctgtttgtctgcaggagttaagtcagctgaccatgtgtatgtcccatcattagcatttacctgctgccacccccctctgctcccggggtgctgtagagccaggtaagggctcccaccaggcctagctgtggggcctaggccaggagggctgggtgagggtgggaaaggaaagaggagcgaaggcagaagggccaccaggggagatctggccggacagcgtgactcctgggatggaaaggagaaatgtaggcaagaggagccctgagctcccgagaacagaggctatacagcctgggacccaggaaccagagcacccaggctctctcagccctgccatgtcctggtcgcatactggtgggcaagttgaaactctccctgggcctctgcttcctcatcagaagacaggagaacaggaaacctgccccacccaccccgagagctgtcgagaggattaaaggagataatgtaagggggagcgcagccacgcaactgggaggctgttgggaaagataaataaagtataaggtgacagatgtcagctgcccgagcccagaagtgctgcgggagcagctgtctttagcccacctgcctgcctgggggcagtgaggtgggaaactccctgcacaccgaccatctggacgcttcttggccctggttccccaaagagctgagctggtggagagtggctaggggagggggtcaggattctttacctctccccgcttagccacctgcctgtgtccccagcccctcccagccccaggcagccactaaagtactatccatctccatattgccccttctggacattgaatgtgaatggaatcatgcagtatgtggtcctaatttttttttttttttttttttgagacacagtctggctgtcacccaggctggagtgccgtggcgctatcttagctcactgcgacctctgcctcccaggttctagtgagtcttctgtctcagtctcccaagtagctgggattacaggtgtgtgccaccatgtctggctaattttgtatttttagtagagacgggtttcctcatgttggccaggctggtctcgaactcctgacttcaagtggtccacccgccttggcctcccaaagtggtgggattacaggtgtaatctttatcaacttcactccttatgatacaacttcattaagtgatacaacttcactccttatgttgtgcataatcctctaggttgcaaggatccttacactcagcatctggatggatacaatccactgtgcctggctggtcctaatatttttgaagttcaagttcattcacattatagctcctatcagaacttcactccttttttttttctttttttttcttttttttttttgagatgggggtctcactttgtcactgccaccttgaattcctgggctcaaaggatcctcccacctcagcctcctgagtagctgggactataggcacatgccacagtgcccagttgatttttttaatttttagtagaggtgtggtctggctatcttgcccaggctggtctcaaacccctgggctcaagcaatcctcctgccttggcctcccaaagtgctgggattgcaggtgtgagccactgtatccagtcacctgaacttcactccttttgctggctgaataatgtttgaggtgtggattcaccgtgttctgtttatcctttcatcagttgatgggtgtgtgggttgttctttttggctcttgtgcataatcctctaggttgcaaggatccttacactcagcatctggatggatacaaggaagggtgcttgttaacctgcagatttatgggcccatttccccacagattctgactgtgcgcgtgtgggaagtgcctgagaatctgcattttataagctccctgggtgactcaggtgaaggtatctgcagaccctttgagagacacagccctagtatattcttggttatacacactccccatcctaagcctccaggtctcagaatcgtatagccaggcaggaatctgaccaggacatcagccaggtgtggctgtgtcctaagcagccagctgggctttggtggctttatgagctcagcagggtcaactttggccttctccatccagcctgaaggctgacaggccccagggacacccttcctgggatcaacgttgcctttattgaggactcccaggatggtatgtttacaactagaaacatggccagcaacaaattctcctttaaagaaacaaacaaacaaacaaacagaaacagaaacagaaacagccttacaaggcctagaatcaggatttgttgtggtttagttttacctgtaagaatgaaggggctgtggcctggctccctgggctgcagataaagccagagccagattatctgctgaggcttcctgagtaggataggggtgttggtataatatgatttctcctctcaaggctacagccatgttggtcctcctgacttccaactgggaaaaacttgaggcccagagaagtgttggagcttcctaaaagtcacacagcaatgtcaaactgagcctcacttgtggcaccccctccctcggagatttttgccactagccttggaggctgtgggaggaatggtctaagtcagtggttctcaaccagggcaattttgcccccaggaacatttggcagtgtcacaaccgggggaagggtgcgactggcatctagtgggtagcggccagggatactgctcaacattctacaatgcacagaactgcccccacagcaaagaatgatccagcccaaaatgtcaacagtgccaagcctgagaaagcctggtccgtgctcaggcatttggaggccagaaagaatcctgttaaaagtgcaaagctgataaatgcagctgcagcctagtagtgtgacatgctttgtgcaaagtatttctcacctagatgcttgggatgagcctggtcccccgatagggacacagcttatggatgagacctcctctccctggcctgaggcccccacttccctacgggatcttgagtttccagcttaaaagactccgactccgtctggaactctggaaaggtcaaaatctgcattgaactaagagcagggctgggagaggaggccgtggaggtggggtctcaagccagagcctctgctgagttgggagcctggagctgcagcagcagatgggcttggagggacagagctctggcttgaagctgcccgcctcccatgtgagcaaagttgccattgaaacctcccagagacaggcacccagtatgagcatgagaatgcattccccgggggggctgtgagagagaatgcccatgctgagcccacctgcttaaggctgggggaggagctggctgaagccccacctggggtgtggcaacactcagctccctatggcaggtgagcctgccttggatgttgtattagtttgcaagctgctgtagcaaagtgccacacactgtgtggcttcaacaacagccacttactgtctcacagtaggtggaagtccacaatcaacatggcagcagggaagggtttgctccaggcctctctccttggctttatgcttatttatttatttatgaaacagaatctcactccctgacccaggctggattgcagtggcataatctccgctcactgcaacctctgcctcctgggttcaagagattctcatgcctcagcctcccaagtagctgggactacaggcgtgtaccaccacacccagctaattcttgtacttttagtagagatgggatttcaccatgttggctaggctgttcttgaactcctgacctcaggtgatcgacctcccaaagttctgggattacaggcgtgagccaccatgcctggctccccttggctttagatgagcatcttctccctgtgtctcttcctagcagcttccctctatgcagacctgtgcccaaatttccccttttcataacgacactcgtcatagtggataaagggctccccctactccaatgtgacctcatccttcctcaactgattacacctgcaacaaccccatttccaaataaggtcacattctaaggcactaggcattagggcttcacaacatgaaatctcggggggacacagttccacctctaacaagcgggtactccccccagccaggcagctgtttgtccactcgtgcccttggagaagcatggtgggcaggctgggttctgagacccacaactctgaatctgcccagctctgcactttgcagtgaggctgtgggtaatttacttaacccaactgattcctcatctccaggcaagtgataataagagtgccctctctttttttatttgtttgtttttgtttttttgagacagagtctcgctctgtcacccaggctggagtgtggtggcacaatcttggctcactgcaacctctgcctctcaggtttaagtgattctcctgcctcagccccccaagtagctgggactacaggcgcgtgccaccatgcccggctagtttttgtatttttagtattttagtagagacggggtttcgccatgttggccaggctggtctcgaactcctgacctcaagtgatctgcccacctcagcctcccaaagtgctgggattacaggcatgagccaccgtgcccggcaagagtgcccactcttaagctgtcagggaaaacacacgccaagcccttggcaccatgcctggcacaatcaccactccctataaacgaaagctttattcagcaaacgtctcttggacatctgctgtgtgccaaccaggggggcctttagagggaggctcagaggatgtacagaagcctcccctagtagggactgcatgtgctcacggggtggggggggtgcctgggtgggtggggcatgcgtgtgctggcctctgtagatgcacacgtcagttctcggatctgtgcagtgaagagccttggcacattgagtggaaggtgaagctccagctctctcttcccgacccagtgtttctcacaagaaaccccagtgatctgagctgagaaccagtgccacagcctgcccatcgcctctttgccttgctcatgtaatagtccgaaattctctctccactccacctctctcattctttaggactcaatgctagtgccacctcttccaggaagtcttcctctaggagtaggattaggtgcctccctgtgctctggcactttccaggttattgacatgatccttgagggtcggaaggcaggaaacctggcctccttttgcactctgtccctgagaccttgctcagcaagcgtgttgacctggcctgagcaccccatgctggtctccctggcagctcagagcacctgtccccacccctctccagctcagctctggctcacctggaggaggggcacaagggctccattgtgtgctagaggggacaggaatagggtgatgctctcgagggtggggcgggggctggagcccggacagatggaacccagacaaagccctctttaagcggggatcgtggcagctgtgctgacagtgtactacaggagcctggttagctaaaggaaccaaatgcccaggacgctgtgaacttggcagtgtctggaggttgtatgaaggtcatgggtgggatgggcattggtgcatgccactcaccctccctagcactgaaggcccccctcccagagggtgctcctcaggccactggtcctccccgtgtccacaggaacaccggcattgggatgagagcgggagcagctggctgggttctggttgcatcccatggggacccataccggggaactcagagccaggttttaccttcagtggggtctgacaccagagcagggctcatgctgcaagctttggggcctgggacaggggccagatcctagaagaggctcactgtgaccacctagcttctggccagctggcagggagcctgagtgagtggcctcattcttttccccgcacaaagcccccggtccatcctatctagagccctctcctgtaactggctgacctgaaatcccatctgattgggaaagacttccacatgaggctgccagggtcaggcctcctcttcccgcttccctcctccactgagaatcccagaaggggccttgccagatacctgatggtcataggttagttttgatgcattgagcacaggtatgaacctatcccaggagtccaggtggtgaaggaagggggtttgacccagggcacacgtagaatgctgagggagtctggtgggagccccagggctgtcatcctcctgggactgggcattctaaatccgcaagctcgatctgggtggacccagagggacccacgaggatctcctggatccatggagcccggctgtgctcacagctctgctgcctgctgccccctcaccagcctctcctcaccccagagcggccacccctcatgccttgtctgttcccaagccctttttgggactgtcaccagccctggctcccctgctgacccaggaagggagcatagcccctgtctctgcttctatggggcacccctatgacagcccaccctcctcagtaccctgcccgctgttaggactcagtttacctccttggacagtatcttatccccggttgagttaggtagggctaatgcacaccctgggtgttggggcttcctggaattacaggaactactgagggacagggcaggaactcccctacctgccccaccccacaaggcccctcgtgggagtaggggtggaagtgtgtgcgtgagaggcagtttagaagggtagccggagcaccagctgggacccagactgccaggccccagtcctggctctgccatttcctagcaacatgactttgtgcctcaacttccccatctgagaagaatcatcgtgatgattcaaattgaagtgctcagtcacaatgatccattgtgattatgtgctgggaggagggggctgcccatgccctacctccctcgccaccttccctcccactgaaagaggggaccgatgagacacccattccctacctccctcgcccccttccctcccactgaaagaggggaccaatgagacacccattccctacctccctcgcccccttccctcccactgaaagaggggacgcatgagatgcccatgctggctgaggctgccgtcatgcactccgttcagcacccacggccccagggagcatgctcccttctcatgaagagcacggtggtggctcattttcccctggctatcacaagccaggaccccagggagcccaggcgtccccaggcgcagagcagcatttagaggcgccagctgcctctcagggggcacctccgcggtgcagtggttgggggtggtgcatgaggacagggactatggtccaaagggacctcaggcaggtgcagggcctgtggaatcccagtgaccttctccacggtgagggtggagttgtgggtctcgacttgatggcagagtcatgggtgcggggaacaggtggccactctcagtctccacccctgccctcttaacagcccgttgaacaaagactgttgagctcttggcacatgcccagcgctgtgcccaagcacattacacgttgttccagggtcttcccagcgctgcaggtggatcatgctgctgtcccatctgacagaggaggagatggaggctcaagcaggttataccaggcccgaccaccaataagaggtcacagggccctcagtgcctaccctgattctcctttgctgcccctgctcctctcatcctaaatcctccaaactcaagccctcccacgcatctttgaatgtctcccgtcatttccatgaatctggcattgtctctatcccctcccataccctagactagggcccccagcaaggacgcagcctccttcctctgcatctctgcatagagctcgggacaaggctgagtacacaccaagtgcacaggggcagaggcaggggcagagtggagcaggccctgagatagttctagaaaatgggcccctcggttacctttggaggaagggaagaacccggccaggacccttctgtgtctcaacacacgtgccagcaggtatgcgcgcgcgtacacacacacacacacactgctgccactcctaccctgcagggaggggagccccagctgggattggcccacccatggcctgtcctggctgccagcccaagcccctctgcctccctttccaccctttccactcccggctcaggctcaaagctgcaaagggccactggagcagttccctcacagccctctcagctgcgagtggagatccccaagcccagcgtgctgacctcatccctcacccagctgcctgtggctctttgctctgtcccaggctctgccctggaggggtgaggcggagcaggcagggctgtagcgaggtggataggagtcagtggactttgaactcagagcctggttggcaccctgggtctccccttgctgatgtgtgacgacctggggggtgtgactcctttggaccctgatttcctcatctgtaaggtgggagtcatagctggccttagcctggggtcatggctggggttaaaagagactgtgtgaggccgggtgtggtggctcatgcctataatcccagcattttgggaggccgaggctggcgggtcacttgaggtcaggagtttgagaccagcctggccaacatggagaaaccccatctctactaaaaatacaggtggcacacgcctgtagtcccaggtacgctggaggctgtggcaggagaatcactgaacccaggaggtggaggttgcagtgagccgagatcacaccactgcactccagcctgggcaacgagcaagactccgtctcaaaaataaataaataaataaaagagactgtatgtgtgggtgcttgcaacaggtcctgacacaaaatgagccctgacagatgctgcccgttcttctgttgcacctctctggcagaggcagcatggggggtgttgaagtgaggggcaggcccccagggtctgggctcgtggtagcctgggcatcacctgtgtgtgctctgctcccctggggctgtactggccttgcagaggcaattgctcgttgtcaggaaggtgtcccctttgggcatccaagggcagatgatggcgagcctgacccgacatgggaaagctgaagaggacaggaatgggctctggctccgagacctacctccagtgggacctgggccctggactccggcctctggcccctcccatctcttgcccacatcctgaggcgacgagggctagattcagagcccagaagggctttgttaactctgatcgacaaaggggttaactttgttaaccttcctgagggttgacctcatcagggcccggggttcccaggtgaccgtgggcctccctctggggaccttgcagatggtggttctcatggacccaatggaggatcccgacgacatcctgcgggcgcatcgctcccgggagaagtcctacctgttcgacgtggcctttgacttcaccgccacccaggtgagggagggcctgggctggagacacgcaggagcccctcccccacccttagccccactcaggaggggccctccagggcccctgcctttgaacctcagcctccactccacctgctcaccctctgttccttgagccttccccattcaggaaggttctcatgcacacaaggcacacacacccggcctcctgcaaggatgcactggggttggcactcagacaccaccctacacggtacaactcgcttggctcctactgagctggaaaaggagcttgaaggccatctggtgtggggaggacaggggcagagggtgggttcagcgaagctgacaccctcctcgaggacccccatctcgcccatctgtgggatgctcccaggaacagatgtgatgcatcctcagggcggggggccaggagccagctgcgcaggaaggcgtctcaggtgtcctgggctctctttcagcctgacgtcccccactgtgagtgtaagcagagacatcccctcccccaccccccacccccacttatcttggggctggggctccagggacagaaacctctcctatcagaggtcaggaagagccagtgggtgcctgtgctgtgccccgcctgtgtcccggcccctgacaggcttccttcctcgcaggagatggtgtatcaggccaccaccaagagcctcatcgagggcgtcatctcaggctacaatgccactgtctttgcctatggccccacaggtaaggggaatgcccagactgtgggcgaggaccgcaatgcccctgtaatccccgtcaccctccaactagtctgaccccagctggagcaggaatccaggatgtggtcgctccacatctcacccagggccctccagccccagaggccccaacccgagccggggcatcatcctccccactccccaccacctccctggccctctgagagggcccagccttgaggacaaaccccggtttccaggagtgcctgcccagcaaggcctccctcccagccccaccccggtcaccctccaccttgttctgccccaggctgtgggaaaacctacaccatgctgggcacagaccaggagcctggcatctatgttcagaccctcaacgacctcttccgtgccatcgaggagaccagcaatgacatggagtatgaggtctccatgtcctacctggaggtgagtcccccagcctaggctcagatggggctggcctccctccctggggctggtcactgtgcagcttcccggggcgctcatcactgctgccctcctgcatgcctactgtgagctccactttacaaacatcgcaggctcatcagagaggttaggcaactaggccaatgtcacacagtaagcgagggagcggggattcaaactcaggaccctgcagcttcaaggccaagctccgccctgtgccacgctcaccacctcaccatcctcacaggcccattccttagagcagaccctgtctgccctgccaggctgcctccagcgattctgtgtatgtgggtacagtgaaaactgaacatacatgtacagtctggaacctgtgggcctttgccacccagccacagcctcctggtgcccaccccatgggagtgctatcaccagacagtgatgggatgtcagggactggggaagcacacagagtccagaagaggtgggaggctggacttcatctggctcctccgggagctgataatctcctgggtgacatcttaaggaggcagtgaggcacagcaccagcagctgctggccaacaaggtgttgattcagccagcaagactcgctttacggggtgggggtgcccccagaaggagcacaggggttgcctagcaatgaacagggctcctcactgggtgggggaagggggttctggtcatttgtcaggtccccatgcaactaggtcaatgtcacacagtaagtgagggaatggggattcacactcaggaccctgcccggtgcccagcctgtctggaaaggggtgctccttggtttcaaagcctcctgtaaccttggctccagcagcccgatgtttcctgtggatgctgaagcccctgaccccataggaaggaaagggcctttcctcctaatcagggctcttctgagaagagcctgggctcaggaagggtgaactcttgtccctttcctgcacgaaaggaaaggggactcagccctggccttgacctcctgcccttagtctcccttcccccacccctcccccacctgtcccgtcagatctacaatgagatgatccgggacctgctgaacccctccctgggctacctggagctgcgggaggactctaagggggtgatccaggtggccggcatcaccgaagtctccaccatcaatgccaaggaggcgagttttgtgtggccagcctggagccgctgagaggaagctcaccgcctgaggggcaggaggggcggggacagaagccagggagctgctccccactcggctgaggctgggacagacaggagaatcctgagtggcagcaaggaggggactcacacctgccccaatgcccccaccacgctgaccctgggagagtaaccaggcaacactgcctctccatttacacagagaccctgacctccagagagccgaggcccacgccaggcctctcagcacacggagcccagcccactccagcctgccctttcccaactgctcagacataggaccctccctgctagccccctcaggggctcctctctgccggagcacctacggcagtcgctaagagctgcctctcctccctcccacccagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcaggtgaggctgggacctgggctgggcagaggagggagggttgacccaggcaacagcggagggcaggaatggtgactcccatgcaaggccagcaccacaggaacaggggagacaggttgggaggtggggacagggacgctggcatctcagcttcgtaggagttggagcggggaggatgtcgcagcgaggtggaggggatgagtggagacccccgggttaaggaagtgaggaacgttccagaggagcagggttggggggaatggggtagggcatcccgggaagagccaaggagctctggtgggaaggggaaggaggatgggggtttctccagggaaggagactgtggctgccctaggggagggatccaggaagacaatgaatgggcccaaaggagtagttggaggcagggagagacaagcatcccctgactgggaggacttgacacatcctgggagaggacccagccagtcacatcacaaagaggagaaggtccccgtcacccatttctggcagcatctttgtcccctctcatgaagcttggctttgtggcagcacctttgtcccctcccatgaagtcctgcttgccgagctctgcagccttggtggcagcaccacccagctggtgtaggtctgggctccctcgtgcaggcaatcttgggggttttatggtcacctgagcaatgaggctgggtgatgtcaccattgctggcactggaacaaatgcaagggaaatgacagtgccagaaagaatgagcagtcttttgtctttgaacatctggggtcggatccgaacagggcaggttcaagaaacttacccctcccttccagtaaagcctggggggcttcctggaaggcacacaggggagaggcctgggaggagagagagtgcccttcagccactggagcgagctggtcccggcttctccaggctgggcagagccacctcctaaggggagctgcaggcagggcctcctcggctttgacatgctcctgcaggcccaagaaaaggagaagaacctgccctccaccaccatgcacatgtgcacgcactttcctccttgctccctggagcaccctctggagcaccagtggtcctgccggctcccagctgagctgcctggaaagcaacctccctcccatctcatccatggcactgtgtgtcaggccgtgccacggcacctgccctgaggagaaccggccatctcagccctcctcagaagctgtcagcccatcactcttgttcagaggcctctgggtctcttaaccttctccaatgccctcagtggccttggcaggaggacggccacaaggtccttgggggtttattacccaggatcaccaggtcattcattggtggggtggctggggagaaacccagtcccctgcctcatcaggccacacgtgtgccctttgctcgccccctagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggtaccagccacagctgggcctgggcactgggcaccaagggtgaggctgccagattaaacaaatgaaaatacagggcacccagctaaattccaacctcaggatacacagcaaaatttattttagcgtaaatatgtcccatgaaatatttgggatattcttatgctaaaacaaagtaattgcatatctgaaattcaaatttaactgggtatcctgtattttatctgacgaccctaaccaaaggctgggcaatgggaaggaaaaggagcacgtgatacccccacccagggctgtgggtcagagccgtctagatttgggggtgcaggtgggcagtcagcctcatggccccacaggtcagctgtttgggggtggcctcctttgtgcaggggtgtccttggccttaaattatagcagcatcactgagcgcccactcctggctggtctcttgaattcagtacttcactctattagctccttagatctcgtcaacaactctatgagtttgagggattacatttgcagatgaggaaactgaggcacaactcagttaggtaatgttcctaagggctcacactagtaagtgctgaaagtaggatccagtcagaggcctccctgatctaatatcagagtcaccgcttacttaacattgccagcagctgccgtcatgactgcacctagaagccggggaggtggggacaattgcaaaaggactgcccccttaaaaagcaaggaaagccgggtgtggtggctcacgcctggaatcccagcactttgggaggccgaggcaggtggatcacttaaggtcaggagttcaagacaagcctggccaccatggtgaaaccccatctctactaaaaatacaaaaattgcccaggcatggtggcagacgcctatagtcccagctactcgagaggctgaggcacgagaattgcttggacctgggaggtggaggttgcagtgagctgagacagcgccactgcactccagcctggatgacagatcgagaccctgtctcaaaaaaaaaaaaaaaagaactaaagaggtgaatgagctttattaaggttacacagctggtaattgctggagcagggctttcttcctcccaagcctcacaccatatgacgctcagcagccgggtcccttaagtgtaaagagacagagagattgcactcgccagggagggcatcgtgaacagcctggcaggaggaaggcctgaggaggcagtccccactgaccacagccacctcccatccaggactctctgggaggaaacagccgcacagtgatgatcgctcacatcagtcctgcgagcagtgccttcgaggagtcccggaacaccctgacctacgccggccgggccaagaacattaagactagggtgagggcccctggaccgtccaccaggacacaccttcctgggctgagattcaagcccccgggctgatccctgccaccccactgcactctctggaaccagccactgctgcactggcctcattccctagttgatcgtcacctgtacactttccctgcacctccaaaccctgctcctctgccgggaagccgacagctcccaagggtccccgcttcctccagtcccaggactgtgctccccctgcctcatcccctcttctcttcccttcctcgtcttcagatgctcatttagacctttgcatttccaaagcacctcttcatgatggtcatcacaggaggcaagcttcattgagcacttgctctgagctgtttcacatgctacctcctttgatcctcaaaaaacagcagtattattgcggttcccatgtacagattaggacagcaaggcttaaggaagttaagtgacttcccagctggccagtgatggcgctgaggatggaaatgagatctgccccgtttccaagtccgtgtcctcacctgtctgtaagcatgtcggaacccttgccatccgcttagaaatccatttccacctgttcgtgtgtggaggagtgggaatggattcatgtatgatagcatgtagggaacattctcccaacacctaacacttgccagctgctgccctgagggctgtaagttttattccaacccctcaatgggggacgggagacacattcttgaaacagctcattgatggttcagaatattcctaatagcaggtaaatgatgccaatggtaggtgctggggcaagacaggaacaggaggtgggggtggcctggtggggtccagtggaactctctggagactgtgagtgggaccctgaaggctgggaggacattccagaaaggtgggagcagggagagcacaggttccaaaggcaggaaggggatggcgtctgtggtgggtatggggagagcaggacaggtcttcaactggagtgggatgttcatgcaggagcggtgagcccagagaaaatcagagagatgggggtggcccttcaacaacgggtggaggaatgaggacgttccccgcaggcattaggaagccactgaaggttgatgagatctagcagtgagtgtgacaggaggttgtggaagtggaggaaaggaggccattactgtcacccagaaagactgggggaggcagggggaagaaaggccctgcaggcaggcctcggtgagtgcacctggggtgactgcatcccctccgctccatacgtgttccctgcaggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaaggtgcgcctgtgggtctgtgtgagtggcagccccctccggccagcctcacgttgctctgggatcaggccatgttgtgttcaaatccagaatcgggctctttctggctgggtggttgagctaggcactcaccagctctgagcctcctagcattcagctgttaaatggggttgtgatctctgcttcagacagttaccagagatcacaagccgatttcccaaccccaccttggaagagtaggtgggatcccacgagggagaggcacgtgagcaatgagctgcgcagggcgcacactaagggctgtggcgtagggctgcgaggtcatgcctgcacccccggaatgggctccgtttccttgtagacctgcatatttgctatgatggttttccaacagacagtaaagctttttttaaaaaaaaatttactaatataaagagagaggcagacagtaaagatttttttttttttttgagacagagtcttgctctgttgcccaggctggagtgcagtggcatgatctaggcttactgcaacctctgcctcccgggttcaagcgattcttctgcctcagcctcccaagtagctgggattacaggtgcccgccaccacacctggctaatttttgtatttttagtagagacgaggtttcaccatgttggccaggctggtctcgaactcccgacctcaggtgatctgcctgcctaggcctcccaaagtgctgggattacaggtgtaagctactgtgcctggccacagacggtagtttctaggggcacctttttatagttggcacagaggtgctgtaagggttagcaggagcccagttcataccaaggagctgggaattgcttttgggcaacagcttgaagactcaatgtgggagtggggtctgggaggatgtagtaatctagggggtcttcctggaggaagcagttggacaggaagtgggagcactgagttgggaagaaaaggaggggaggggcccaggtgggcccaggctttgctagctgaacttgccgcctcctctaccttgcccaccctcacccatcggcagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccgggtaagcccccctcccaggaccctccaggccccacccctgtgcctgggacagaggagcacgacctgtggctgtacagtgtgccctgcccccatggcctgaatgccctgtctctctgggtggggctgcggcagctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaaggtgtccagggtttggggggacaaggagagtgggtttaggggacagggtgagcaggtttgagaggcaaggcggaggggccagggtgggggtagccgtgagacttgggaactcaggccacaaatcctgtgtgactttgctaagctctttaacttctctatgcgtcacattccccacctgtaaaatgggagcagtccatggtgcagccctcatggggttgctgggaagattacataaatgcctggcacataccaaggactcaaaaaatggtaactaatgttataattagggtttttcaggctgggcacagtgactcacacctgtaatctcagcacgttgggaagttgaggtaggcagatcacttgaggccaggagttcgagaccagcctggccaacatggcgaaatcccgtctttactaaaaatacaaaaaaaaaaaaaaaaaagcctagtgtggtggctcacgcctgtaatcccagctactcggatggcagaggaataagaatcacttgcaaccctgcagaggttgcagggagccgggatagcgccaccgcactccagcctgggtgacagagagagatcctgtctcaaaaaagaaaaataataataataattagggttttcccaataacagatctttgccttctgttctgggacatacccagaccaaaggggctttagggtatcatgagccctgagggggtcacatgggctggggttgagcagttatcccccaagctggttccaggggtggtttgcggtcaggatagcaagaaagtggacactgaggggccaccttggagcagtccctgattgtaaggcccaagattcagcttttagggttggcctcaggctggagctccagacagatgcctggagtccaggcgctggagggtcgaggacgagctgggcaggcggatcggacccctctccccgctgccagatgctgacctgcgcctcctgcagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacggtagggcccacgcccccgcgcatctgagccacccgcgggggggccgctggcactcactgagccctgccccttccccagcagactacaacctggccgtcccgcagcgcctggaagagctctacgaagtgtacctgcgggagctggaggagggcagcctggagcaggccaccatcatggaccaagtggcctccagggccctgcaggtgggtgggcgcctgggcggcctgaacatgggcacatgtgcccagggaggggctgatgaccaaggcaatgccttcaggcagctggaggggacaggaccaggctggctggcaccccagggagttgactccctttccttcttaccccacccaaagccttgtcaagcctgagtaagaccctcctccttgggcactcctgggcatcacttgctcccacccagggtctgagggtcagggctggccatctgagatatcacaaatggctccagctgccctcccaggagaccaagcatcaggcagtgccactggggaagcctagcagaccacagcttaaccccgaggacccaaacacaagcccactgcccttctggggctcccaggccatcttacagcccttgtcaccctgtaagcctttgtgactctgtgctgatttggtccaggaccaaatcttctaactgtccaccctggctccctcctccccaggacagctccttgcccaaaattaccccagcaggaacctcactgaccccagattctgacctggagagtgtgaagacattgagctctgatgcccagcacctgcagaacagcgccctccctcccctcagcacagagaggtgagatgggggccacctgccccagcccccaccctgtgccctgtcccagagaggccaacccagactaaggctaaatggggaacacagagcagcaatgagagggagcaggtggcccaggtctggagccaggactcctgggttctctctcctttcacaccaacagcttctcccctggggtgggggtgggacctcggtgagatagcctggtctacagccactcatcttcctctgccaacttcagtgaaggccaccacgtgttcaaggctggtactggggcctggcaggcaaaaagctcctctgtgcccaccccacctcccatccagctcggcagcctggtgacgcaggaggtgagctctcagtacccgatggccccacgagctccactgcagcgggtgcgggacatgggggtggacagcagcagttgggatggaccctttcccaaacggcaccagcttgaggccccgctgtctctgctgagtggggcatggggtccctgctgtgtttaagggtttcctcctcccaaccactccaccccacaggccccggctcaggacagcctgggcagctggatcaactcttcccctgacagcagtgagaacctgtcggagatccccttgtcccacaaaggtatgtgtgccctctgctgcccggccacctcacctggccttgtctaaactgttcagatcacccagctcaaagccctttcctgccctctgcactgccaagtgcaaccaagcattgggtgctacacattctgtagaggcaccattgcccctgaggattagtcagtcaaggacacttaagagtcttctctaagtcaaggacatttagagagatgggggcagaatcggaaattagaaaagagacatgtggcatggagacttatgtcccccctcccccgccgcctccgctcagtaatcactgtaatagcaaatatcgattcaatgtctgccccctggataatgtaggttgagcccatttcctcaattaatcctggaaataaccgatggcattagttttaccatcccccatttgcagatgaaagtgaggctcggaaatgggcccaagtttcttacatagcaaacccctggaagtgctaggattgaaacccaggaggtctggctcctacccacgtctgccatgtcagaggagggtgttgagaggtggccttgatctcgggttgtatgttccccgtgtcccgctgcagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaaggggtgaggcgaggcgcaggggtgggtgtctaggcactcccatagcagctggaggcctgagggctggatttctccaaaggctccagggcacctctagcctaccccatacctggaggcaccaccctccacagtctctgtccccagcctagcatagtagctgggacagatcctggtagcagatccctgtgccgctctcggcctcaccccactgttcaaccatcacagctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggtcagtatgggcaaggaggggatggggaggggaggcctccaccaggcaggggagcagagaagacacattgcatttcctgcgcctctggctgccccttgctggaagcatggttctagcagaatactcatgggactggcatcctggggtggtgcccctagagagttcaaggccactgggtgatgggagaggagttggggaggcattccgaaaccactgatcctgcccctttccctgttgcaggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttgatggttgtgttggaaatttgaccttgtctggaatgtggggtggccatgactaagattcaaccaactcccgctccccctagtccccatctacccctggctcgctatatagcaccaacctacaaatacctgggggagaggggtttttctctagatcctgaggcctctccccatggtggggctagcaagatccgttatgtccctatcccactggccttcacacctgcccaggcaccctcccaggagaggtcagggacctgaggcggcccagatgccagaaagtctcacaacccagatgaggcggttgcccctcgaggtcagggctcagaaactgcccagctaagcccctcagcctcaaagtgaggaaactcctgcaaggggaatggggtgctccctgactcccccgcaaggggaatggggcgctccctgtctcccaggcaggtgggttgctgtgaccatgtggatgcttttacctgccctagttctgtgtctgggtggggggaaagctcaacaaaggggagtgaaacccctaaaccccctggcttgtgggaccctccctgggttgtttttacccagaaactgagtggttcaatcatccctttaccactctgagcatcggtttattcaggaccaagaacgttccttcaagtcagctgtgaaatcagctcttgaaaccaggcatcttgtctaccacgcctcacctggactccaccccagccctagggtggccggcgcctggccatccaggggaccaggcttgttgccacctccaggctcgccttgcccttcccagacccacagggaccacctaggccaggcctttattcccagaccccgaggctacttgggggtccggataagggtgtggtatacgggcttgacgatgaggtgcaggtgcagggcgttctcaaccaggtactcggagttgcgccgctgcaggtcggcgtgcgccaggaagtcgccggcctcctcgctgctctggtggaagctgtaggcgtggcggaccagcaggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgcggcgagaagagcacgttccaggtgacccggcggcccgcgtcgtggccactcgggcccagctgcgtctggaagctggtgctgcggtcgtcgcgggccgggttgttgatgacccacggggcgccccaggcgggcgcgaggtagttgcggggcaggaaggcgctgccgttgacgtcgaagaacttggcgtagtgcagcggcgacgcggcgtggaactggtaggcctgcagcaggaggtcggccaccgcggggccgtggcgcgccagggctgccgagcgcgcctgcagctggaacagctgtgccggtgggatcatggggtagcgtatggcgcgcagcgcccgctcggccacggcagggggcggccgcgcgcgacccagccaggcctccagcgcgtggaacagctccagttcatcctgcagcaccaggtccgagcgttgcaggagctgccagagcagctcggggctcacggcgccccactcggtgctggccgccacggccgacaggttccaggccaggaactgcaggcagctctcgcgcagggcctcgtccccggtgcccaccgcgtagtggtaccagcccaccgccgggcccgcgcctcccgccaggtgcgcgcgcatgtagtcggccacgccgcgctgcagggaggacacgccgtacttggtggccagtctgtgcagggggatggcctgggtcagcagcacggtcagctccccgcagtacaggtacctgcgggagagaccgagaggtggggcggggtcagggcggtacccacctcccaggatagattttttagagtccacaggggacccggcctggagttggagcttcactgtccgggtgcaaacacagtggaagccccaccctgaggcttcccatgttttcctttcaaggacccttccaggccattcttacttcacaggctcttctttccgtttccgcggtgatgtagaaattgcctgcattgactgtgcctctactaggcgtgcagccctaggctggaacaaaacagacgtggctcctgcctttggggtttccagtctggttgggatccatggcctgccttctccttgccatgagtctgggcaagtcacttaacttcagtgaaccttaggctaatcaatcacctaggaaagggggagtggcacacacccctcagggttactgtgacaaccagaggagaataaagaatcttgctacaggccaggtgggtgctagtggctcacacctggaatctcagcactttggaaggccaagatgggaggattgcttgaggccaggagttcaagaccagcttgggcaacatagcaagaccctatctctacaaaaaataaaaaatgttaaaacattagtcatgtgtggtggtgcacgcttgtagtcccagctgcctgggagtctgaggtgggaagatagcttcagcctaggagttcaaggctgcagtgagctatgatcatcatgccacgacactccagctttttttttttttttttttttttttgagatggggtctttctgtattgctcaggttggtctcaaactcctggacttgagcagtcctcccaccttggcctctcaaagtgctgggattacaggtgtgagcccccatttcttttttgcagcctcacctttctttttcctctcctactgttggtgatcacttctgctgagtatctcttcgtcttacttctgccactgtcccatggctcacctttcctgccagtccccaccggcacacggcaccgcacttgcctctataggagtgtggcagccactgccagccatcttccccaacgtccatttctcccctttcccctgcgtgattgcctctgggaataaaagaccacatttcccaggctccctcattctggccttggccatgtgactaactgctggtcaatgggcgcagtttgggatttgcaggaaggctgattaaatgcaactgattccgggttaacaggaagaccctttttgcccttctgtcttatcccctttcctgttgcctggaacttggaagcaatgtatggaattctgcaggcatctcgtctgagccgttagaacagagttactttcttagacactagtgtgaatggcaccccctgagcagcatcacggcaggaggcaggaggtggagagagccgtctaactttttcagctccctagccctgtggttccaaacctggccaaacaccaaaaccacagcgatgctttcaaataaaaaatattcgtctataatggaatatttaggaaaataaaaagtaaataaataaaataaaataaaaaatgattgctggccctaaccctagacctgaaactgacaatccaggttgggatccgtgaaactgtagtttttttgtttgtttgtttggttggttggttggttggttggttgatttttttcagacagaatcctgctctgtcacccaggctggaatctagtggcacaatctcagctcactgcaaacccaaactctgcctcccaggttcaagccattctcctgccttagcctcccaaatagctgggattacagtcgtgtgccaccacacccagctaattttctatatttttagtagagacagggtttcaccatgttggccaggctggtcttgaactcctgacctcaagtgatccacctgcctcagcctcccaaattgctgggattacaggcatgagccaccgtgcccggccccaaaactgtagtttttaaaagctgtctatggccaggtttggaaacagctctgagggggttactaggaaccgaaagtgacatcaaactgcacagatgacacgggcaaagacagggagctgtacagtggaagaagggatgcaggggtcactgtcatcccagtgatgtccggggaaatggacataacaacctctaagggcctgggcttccctgaccctgtaggtggaggagccgggggctgaggaagggatgaagccatcccctagtcttccgcgtccccacctgatgaacttgtcgaagacagcggcgcagtcctgtggctcctgcagcaccgcctcgctctggttacttagcagctccaggaacagctcactgtgcagtcccagcagcaggcggtgggcgtggaatacccggacctcatcggtgcccgcagcctgcacccgcagaaccacatcgctggcgttgccctgccgcagcagctcctgcaagcgctggagcaccgcctgggagtggttgatggaggtgccagctgcctccccgccaacatcggctctctgtgctgcagcaggaaggaacacagcatagcctgagaaggtgcccgggcccagaacctcagtcaggggtggagagggaccagctggagacatatgcatgggtgtgagcagagggcaaggtgggcctaggcgggttgtatgtgcatacctgtttgtgcccacgaggcgcgtggatgcatcggtgcacatacaaacgcaccctgggtgggaaggtcatgccaatgcaaaccccaagaggatgctcttggaagggggtgcattcaggcagggggaggttgtgctcaggtttaggacaacatgcccagaactcatctccatgctgccagccccccaggcaagggttgaggaaactcgtggtcccacccttctcacttcctaaagaattatccatctaaccccttggagcagtagtcagaagtggtgcattcactaacaaatatttattgagcacttactatatgctagacattctcctaagagcttgggatgtggcagtggacaaagcaagccaagttcttatgctcataaaagcacgaattgacatatcaaacgggtaagacacacacaaataagcactccagttttaaaggagccagccagggaaccagtgtcaaggcaggctccagccccgcaaaggcccttgaacggaatgggcctggggtactgggagcagagagagcattagggaggccacagcagtagcaggagagaggggcgggtgtgagacgaggctgcgggtgtggaagggaagctgttttccaggcccagccctgccctcttgggtcctgatctctgagacagaagccgattttctggggtggccagcaggggacaggagaaagtgcgaagggccagctggtgctggaatagaacttcctgggtaactgagcattgaggctggccaggccggccctttgcttatgctccaggatgccccgacagtcagatggggatatgcactcagttatagaaactgtcagcagctttcccaagccgagaacagcgaggggagcctcgcagagggaggcgggcgggggcctgattgcagcagatgggccgcagccacatgtgcacgcacagcacatgcaggcccgtggtgcacacaggagagaaggctcacacaggagcagagcatctgtgcatgagagagggaggccgagggacaaagggagggtgaaagagaagcgggtagtatgtttcccagcacggccttccccagctgtcactttgaaggacctgaatgctgatggcgtccccattcagcctctgcccaggacaatgggcaatggagggtcctcttgtccttaagagccctgcccacctgcctgccaggcccctccttccttcagacagatgagtccgtggagctgtccggtccaccccgtgctctccccagcagctggacaccgccccctcctggccggccgcgtgcagccagggctgggacgacctgccgctccaccctgccccgcacctggcccactgcccgctcacctgcatgggtgaccaggcccaccaaggtcagcatggcccagaagctgccccaggacccaggcttggagtagcctctcctaggcatctttatgctcagcccccaagtccactggagggacggtgaagcccagaccactctgctcacatccctcttccttatataggatccggcacaaggggacggcaccccccttcctgcttggcctccctcccccactcagcctcctccatggattggtggaaactggccccagctgttgcccaggcaaccacttaagccagagagcggcagccccgggggctattgtgctgcctgtgggcccccaaggggaacagatccggaaccctcctcccccaatctccttaccacccagcagggctagccgtgcctctccctggaaagtttcaggctctctgcagaataggcgaggggctccaggaccactggcagccattggcctgagggtccccagttccctcccccaaccccaggcctcggccctggcacagagcacacttggcagcgtcgtgcctggagcaccatggtgagccggctgcaaaggaagggcctggaagaggaaaggagaggcggctgaggctcccacccctcccccactcccattttggggtggggcagctcctcagagagaagctcagagatctctcgaataggggcccatgggcaactgatgtcagtttcatattctttgttgaagaaggttcctggaatgctgtggggagggtgatgggctggcaggaaagttctgtggggactgtgactgtcgcctcccccaggggcaagctgagccaggtggcagggctgggcatagagcagatgcaccctgccccgtgcaccactgcatgggtgacccctgcccagagcggggctggccaccttctagctctgcgctccagccagcccaaggctggggactgtctgccctgctatttcctgacttgaattctccttccccaagtggcctcaggtctctgggttcacctccttggaaggcttgttttaccagcttctgtcttatttcccactgtaatttttccttttccaggctaaggaggcatgctgcagacctggtgtttcactcccaatgtaaggaaactgaggcagggagctaggttgcagtctcagttgggttagtgcagaggagtgctcttctaaaaacaaaggcaacagagagaggaaagtgagtctggagctcagcaaaagcgcgcgcgcatgtgtgtgtgtgtgtgtgtgtgtagggtggcatgctgtgagtcctcacctttgcagggagccagcagggtctgccccagttcttcgtgggagggactcctttgagcttggctaaccgaagtgggtgactcccaagggatctgactccgaggcagggctctaggttggggatgaattaaatcttcctctccctggctctctggatcccaggggccagctcgatgcattgatttctgcctctggctggcacagagacccagcagctccaccccctctctggagccgcagagagagcaagaactgggtctggcacctgcctcgtccgggttggcagagttggagctctccagcccagcggaaacccctccagctgccctgagtttcatgcctggctcccctcgtccaaatccactatcccttgcccactggctgcccgcctgcccttcccatgggctgtaccatgtcctggctcaacccagcaagtccaagtctccatgcagcagggcagccctggtccctgagggcatcccagcttccaagcacagtgctttcgataggaatgttattgatgataagagaacccgctactcagaaaactgtcgtttgatatttgtgcctctcaactccagcctccttcagcctctgcatcagtcattctttgttttgttttgcttttctagaggcagaatctctcagtcaccaaggctggagtgcagtgacacaatcatagctcactgcagcctcaaactcctaggcccaagcgatcctcctgcctcagcctcccaagtagctgggacaaaggcagtgccaccacgcctagctaattttgtgtcagtcattcttgaagggtagccacctgcattagaatctcccatgctccaccttggaaccaggattttcaggggcagggtctggctgtctgtattttctaagtactcccagacaattgttatacgcaccccaagacaagcgctacctactagagctagattggtggcatttcaagtgtgaaggaagctgggaggccctggatcatcaagaagacccggaagagtcacctctgactccccatctctgacaggccccacctcccattatttctaatctcccttatccctggccctcttcgaatgatttagaaactagctttccacatagaggcattctctgttctcattttctttttttctttttttttgagacggagtcctgcaccattgcccaggctggagtgcagtggcacaatcttggctcactgcaagctctgcctcctgggttcacaccattctcctgcctcagcctcccgagtagctgggactacaggcgcccaccaccacgctcagctaattttttgtactttcagtagagacggggttttaccgtgttagccgggatggtctcaatctcctgacctcgtgatccgaccgcctcggcctcccaaagtgctgggattacaggcgtgagccaccgtgcccggcctctcattttcgtaacagagcattgctggagtgtgtgtgtgtgtgtgtgtgtgtgtgtgtatggtatgcatgtgcacatgtgtgtatgcagtgcgtgtgtgtgcatgtgcctatttatatgtgtgtgcgtattgtgtgtgtccatgcatgtgcgtggtgtgtgtgcatgcatatttgtggatatgtgtgtgtggtatgtgtacatgcatatgtatgtgtgggggagtgtcctggggcgggagagaggaagccaggtatttgccctgagccctttttttttttcttttgagatgaagcctcgctctgtcgcccaggctggagtgcggtggcgccatctcagctcactgcaacctccaccttctgggttcaaacaattctcctgcctcagcctcctgtgtagctgggattacaggtgtgcactactatgtgcagctaatttttgtatttttagtagagatgaggtttcaccatgttggccaggctggtctcgatctcctcacctcaggtgatcctcccgccttggcctcccaaagtgctgggattacaggcgtgggccacggtgcttggccaagtctttgagaggaagaatctgcagcactgcatatatatatatatatatatacacacacacacacacacacacacacacacacacacacacacacacacacatatattggccccatggatctgggagcgccataattccttgaaggcaagtctgatgaattcacaagccagcaccatcctagagaggagtgttacttcccgccccagacgggagtgtttatagcccaagccatgtgtctgaggtcttatgaccaggaacctcagaggcaggatttatttttcgagttctgagttgtgcttgacttttcttttttctgatttttgttgttgttgttgttagatatggggtctcactctttcacccaggctggagtgtggtggcactgtcatagctcactgcagcctcaaattcctgggctcaagcaatcctccagcctcagccttccaagtagctgggaccacaggtatgaaccactgcacctggctacttgacttttctttccacaaccccatgttgtgtttttgttttgttttgttttgttttgttttgtttgagatggagtctcactctgtcgccaggctggagtacagtggtgcgatctcagctcactgcaacctctgcctcctgggtgcaggcgattctcctgcctttgcctccggagtagctgggactacaggtacccactacctgtagtggctggctaattgttgtatttttagtagagacggggtttcaccatgttggccaggatggtctcgatctcctgacctcgtgatctgcccgcctcggcctccccaaagtgctgggattacagatgtgagccaccatgtccagcccatgctgtctttttggggaagtttttccaattgtgataagtgatccctttggacaaggaatctctagtactgtaaaagcaacggaaaactcttgcaagcttgggaccagataaagagtttctgaatctgcaaagggggtgatcagacactggactgtggtaacacctcagaggggtgggctccagacgcagcctggccctacctggcaccctcccttgcatctgtagtgcctcctgtcctgacttagggttccctgagtcactgggccacttggactggggacaggagatcatgggtttaagttccaggccccgtgtacacaggggagcacataaaggtaaatatgaggccgggcatgatgtctcacacctttaattccagcactttgggaggctgaggcgggtggatcacttgaggtcaggagttcaagcccagcccgggcaacatggtaaaaccccgtctctactaaaactacaaatattagccaagcttggtggctggtgactgtaatcccagctacttgggaggctgaggcaggaaaatcgcttgaacccgggaagcagaggttgcagtgagctgagattgcacccctgcactccagcctgggcaacagggtgagactctgtctcaaacaaacaaaaacttaaataagaaggaatccttggccaggtgtggtggctcacatctgtaatcccagcactctgggaggccgaggcaggtggattgcatgagcccaggagctcgagaccagcctaggcaacatggcgaaacaccgtctctacaaaaaatacgaaaattagctgggcgtgttggtgcttgcctgtaatgccagctatttgggaggctgagatgggaggatcacttgagcctgggagttcgaggctgcagtgagctatgatcacaccactgtaccacagcctgggtgacagagtgagaccctgtcttgaggggtagggaggcagaaggaaaaaaaagagagagagagaccctggtgctcaggcctggtggctctggctggactgatcagggctgaagacttcagagaccaaaaaggtcaaggtgtggccgggtgcggtggctcacacctgtgatcccagcatttttgggagacccaggtgggcatatcacctgaggccaggagctcaggaccagcctggctaacacggtgaaaccccgtctctactaaaaatacaaaaattagccaggcatggtggcaggcacctgtaatcccagctacttgggaggctgaggcaggagaatcactggaacccaggaggcagaggttgcagtgagccgagatagcaccattgcactccagcctgggtgacagagcgagactctgtctcaaaaagaaaagaaaaaaaaagtcaaggtgtgcggctgggtcttcataacatctttcaccttgcccaggctggctcagaggtgactgccttagtggataggatcccttccaccgtgggctagcagcctaccctggtcactgacaccacaccatgtaggaaagaatcgccaccaccaagaaggggcctctcacctctgtataggctgtgtgctggctgatgacgtggttgccctgtcctgtctgctgctgccactgagctggacatctccaggctccatctcttgaaccatggatcccagcgttgttagcaatgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggtgaatccagctgcctcccagaacaggccttctatggggtgggatggtaagttgctggaaggacgtgcatggggcatcattgtagcaaactcagtccccctcctccatctctccctctcctcgctctgaatccagggagctctagttttctgtgtagcctgtgtgacagccttggttgaaacccttgtgttccgtctgaagaatatttaaggtttccagtcaagtgtacatccctcaaagaaacaaagtgggcttggcatggtgactcacacctgtaatcccagctctttgagaggccaaggcagaaggaccacttgaagcctggagttccagaccagcctcggcaacacagcgaggccccaaactctctctatatctatacataaaatttaaaaaacaaagtgtagggacagggtgggcactcggtaaatgttggcagggaccctccttgcccctcacccatggcagctccttgaagagagggtcagcctcctctcacccctagcctcctgctgcaaggaggtggtggcctggggcgtcatctgtgctacttgcactttctggggctggggtcccagcactccaccagaggacctgccctgagcgggcagctccgtctccagtcccactgtgccacccagggtgcctagccaaaccatgggactttcaggcttgcagggtcaggatgtggccaccagggggcagcagggcctgcgctgtgagtatccgagggggggttgggatggggagttccaggctctgatgtgagatctaactcccagagctgggaagctccctatatttcctgccatattttctgctgcattcccagaggacaggccatgggaggtgattccaggggggcctgagctctcctcccgagaccgtccacggggcatccatgtcccgggtacctgcttgtgggctgctctggtcactcttcctctagggcaggagagccagtctggcctcttctgagtgcacaccagcaacggctgttgtttatttgccagggattgatattcttgagggatggtccatttcaccagggccagggaaacaacagcttgcaggactgtggtttcccagcaccggctgcaggcagcctcgtccggctgctcccagaggatgccccaccctgtgcacggctgcctgccatcctgcccctgggggtagcctccacctcccccaccatggccactgcaggactgaccctgtgcacctggtcccctgagcctcttgggatcatagccctgtctgtggcagccttaccactcctacctggcacgacttccccaactcctcacagaggtgccctactctcttccctttcagtctggatgctcatagagtcagcaccctgagtccttctgcctgtccccaaagtcctcagccccaggtttgaccccagctgaacacaggccagctcacagagtgccccggggcacgaggcagccccccagaacccccatcctgccatcctgcctcttctcctcacttcctgctcccccaggcatagacatacctgtgaaccccatgccaccctcagctcgtctctcctgaagctgaagcccctgcccagcccgaccccttcccctgcctgtgcgccttagagcaccctggtttgctccaccagcatctactctagctctttccccggtgcctccgcccaccagttccttcctcctccttcccccgccccgccccctgcactaacaggctcagtgtctgcgtaaggatcctggggcaaacaaccacttggagagccaaggggtgagaggtacagctggcgatgctgacagggagctgcggggaccctcagaaaaagccacaggtgacccaggactcagggccccagagcatggggcttgagggacgagagacaggtaaggcatcttgaagtggggtgtgctgggggcaataaggtggaaaggcaggagggaacaggaggcaggttagggacctagagggtggagtaggggccaaagctgagagtgagtgagcagtgagccccccggcctcagcaggaaacgaaaagctggagttcagcctgaaagagacgcgcagtgtggcttcaggggaacaggggccagagtggacggtgcttatcctagaccagccaccttacccctgtggactgagtttccccatctgtggacttgggccattccagctttagtggtgctcacctttgaagagggtatctttagtttagaaaagagggggccctaccaacagcctctccttagagggggacagctgttgagtggagctgtgcagacctggggcctccactgtggacctcctagagaggtccctgtgtgtggctggcatcacccgggtcggaatcacccaggttgctgattacaagcacggctgctgcaaccccgcttcagaccctctggcccggaggcggcccaggagcctgcacctcgacaagtgccccctgtttcagagcccctgctaggccgggtgagggcccatggggaggacccatggggagcaatggtctctatggcagcaggccgtgctgccagggacttcccatcagtgggggagccgggccactgagggagtggggtgacatggggtgggggtgagggtggtcttggcaagaattctcacagcaacagacagtgcactcagctgggtctgactagagggtctgcacagagcagggtgactagaaagaccccaggtcagggcggggctgcgcccagccaggttagaaatagaccagaggctctgactctgcccatccgcaccttctagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctggtgagtggggagctggggtctggggacttgggcttggccagaaatggggatcctccttcaatgggtgccagtcctctgtgtttgacccctgaggccctggatcatagacccctggtctttccttgccattgtcagggtgttctgggtcactggaggggaatacaagtaaggggctaggattgggggtgctcacagctaaacccaagttttccccagcagtgagcgcactcttaggataacaaaattcacataggaactggctcagctcagtacaaagctccccgtgctgcccatgccttcagagagcagagcttggggcagaggtgggtgtgtggatatgggaaggacgggtggtctcggccctggggatttccccaagtctgatagctaaacccatgcctgtgtctagggacgcctccattctggaggacacagaaaacctaaaaaggacttggaggacaatgccataggacaggtagctttttttttttttttgagatggagtctcactctgtcacccaggctggagtgcagtggcatgatctcggctcattgcagcctccacttcccaggttcaagcaattctcctgcctcagcctcccaagtagctgggattacaggcatgcaccaccgtgcctggctaatttgtatatttttttaacagagacggggtttctccatgttggtcaggctggtcttgaactcctgacctcaggtgatctgctcgccttggcctcccaaagtgctggattacaggcgtgagccaccacacctggccaggacaggtggctgctgaggacccttccatgtgcacttacctgtgcataaccggggtacagccagtggcctgcagtggatggacagggcagagctggcctgggtggccttctgggcaaagtggggtttcagaaggatctggaaggagaaaaaagagaagccagcgcagcctctgcacatgcagatggggaggtgcgatggcgacaccttggaaagcagagtctgagctctcttctgatgcctctcccctccctcacctcggctgccctcagtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtagaggagggggcccagctagggagctcagggtggctcatggccacatgtactggggcctttgaggttgtacccaaaacacgtttatcaacagcttgctttccttgggtgggggtggaggctcctcctttgggtgtggctcccaggtagagaggaggacaacttagccagctcttatgtttgcttcaccagcaatccctatttcctgggaagatgaaagggcactgccaggcacaggctaatagcatcagtgctgtgggcattcctttgcggggggcattttgcctggctcatcgtgaatgccagattaatgttggttgaatggatagaaaaacggacagatggaggccgggtgcggtggctcacgcctgtaatcccagcacgttgggaggctgaggcaggcggatcacgaggtcaggagatcgagaccacagtgaaaccctgtctctactaaaaatacaaaaaattagctggacgcagtggcgggcgcctgtagtcccagctactcgggaggctgaggcaggagaatggcgtgaacccggaaggcggagcttgcggtgagccgagatcccgccactgcactccagcctgggcgacagagtgagactccgtctcaaaaaaacaaaaacaaaaacaaaaacaaaaaaggacagatggatggatggatggatagatggatggatggatggatggatggatgtgaattgtctccagcccacccccctttcctggtgcctgcttctcattccctgaatggatcacctctccagctcctagtggcaatgccagagtttgaaaaggaagatatcttcaggacttaaggcatttcttaggctggaggaaacaaagaaattgagctgagcaatgggagggggctgcttgggggataaaagcccccagggccagtcagaaaggggtgatcttaaatcagatgtgaggagcccaggcctgtgtctgtccagccacaggagacacagccccttaggtctcaaacaccctggttggattccacattactccctgccctaaaccagtacaggttcatgggcccagaaccagcactggggctatagtttttgttgttgccaatgaggagaaagaaaatggtctcttaacccagggtactaggagaacaggaaaggaggacctagctggagatgaccctgagcttctgctgagccccccgagctcacgccccttggggaaaggtcttttcctccaccactgggaggcgggagttggcagagtccatcagagccatgaggagctctgctccccaccctcagcctctccagggaggctctccagggcccctctctcctctcagcaccaccatcccggagaggcagctgggagagatcagcagatggaactcccagctgctccaggctgtgggtaaacacattagcagctgagctaggaccactttctgcttcctggtcaggctgagctgacctttgtcctgaatgggaggttcagacctgcccccaccctcttagtgggatgacatcagtcaaagagctgtttgtgcacccagcacacagtcaatgcagaatcaatgcttggctttccactttgcctctctgcttctccccagagcagggatgtccagacagggaggttcagctaacccagaaagaggataatgtgggtctccaatgcatttgccatgattctcaactccaaaaaactctgaaaaccaaaacatgtttccgaaatgtgccacaaacacgtttagcggcacagcgtgacccggtgtgaggtgatttctggtcccgaagttgtcctgtgattgtgagtcctgccagccccaccagggactgttagtggagtgatcatgtactgctgtccacaccccacggaatcgtgatcgaacgcgcaccactacatgcacacagcaccttcctctgctctgacgtattctgaattccaagacatgtggtgccgagttcagagaaaggactgaagacctgtaagcccaacacttctgctccggggtggtctacactgaccctgagcaggtgttaaggatggaggaccccctcacccgcccacacctccatgtgcacacacagatgtatccccaggcagggttgatgcacctgcgctttattctttgcttaaggaggagggggatgcaaatgcaggtacccggggagggagaaggtccaccggaggaccagataatgtcggccccagcccagcctgagcctgccctacagaagcgggcacgggaagaaagcacaaagttccatggatgaagaactaaatggaacaacctgcagggaccctgcaggagagaacccagtatcagggaagagcatctgtgtctccatggatggcaacagcagctgggtctaggccagaggcaggatgccttcctcagctggctggggggctgtctttcaggaggccagctgcaatattagctcaactgtctctgagcaccagtgaaaccaggaacttccagaaactgttggggaggctctttcaagacacagttttgttttgttttgttttgttttgttgacatggagtctcgctctgttgcccagtcgctcaggctggagtgcagtggtgtgatctcagctcactgcaacctccgcctcctgggttcaagtgactttcctgcctcagcctcccaagtagctgggactacaagcgcacaccaccacatccagctaatttttttatttttagtagagacggggttccaccatgttggccaggctggttgaaacaattttgcattgagccaccataaccccagtgttaatattgctataacctcacttgtaccgacaggctggggcagtcagtgactttttcaaacaaccctgcatatggagtattgtaactgttttacaaacttaggaaattgaggcacagagagattaaatggtatgcccctagcccaaagctggtcaagagcagcactgacactcaaacccaagtctcctggttcctggtccattgtctgttccaccccacaccttgcaggtgctctcagatgtagaagattagaggcagaccgctctcggggatcttttgcattgcttagaactttctagtgctggacttatcagatttgagaaccagtatcacattttcctaataaaatgcattaggtggtcaggtgtggtggctcacgcctgtaatcccagcactttgggaggcagaggtgggcggatcacttcgggtcaggagttcgagaccagcctggccaacatggtgaaaccccatctctactaacaaatacaaaaactagctgggcgtggtggtggacacctgtaattccaagttctcagaggctgaggcaggagaatcgcttgaacccaggagacggaggttgcagcgagctgagatcgcgccatagaaacaccatggaactccaacctgggcaacaagagtgaaacttcgactcaaaaaaaaaagagaaaaaacacattaggtaacagtttctttttagcatttgtgtaacctttaataaaataaagtgataatcaccttggtaagcatgtcactgaaatgtaaatgaaaagtattattaaatctgccaaactggcttctagaggagagaaagacttaaatggtttcagtttctccttcttcccttctccctccatagcctacccactcatctgctgaaatatcttagctaaagaaaatcctttttgaaattctgagtttctttcctaacaattcccaccacaggtttgatgtgctgtttgatcttacggtctatcatttgtcctttgttaatatctgaggatggttattgctcacatgtctttcatttcttcccaagggtatatatgatttttgctgtttggaagttggttgacaaattgttttctggactctattagttttcaagggctgcattaaaaaaataccgcagactgggtggcttaaacaacatatgagtttttgtttgtttgtttgtttgtttttgagatggagtcttactctgtcgcccaggctggagtgcagtggcacaatctcggctcgctgcaacctccacctcctgggttcaagtgatcctgctgcctcagcttcccaagtagctaggactacaggcatgcattaccacgtctggctaatttttgtattttcagtagagacagggtttcgcatgttggccaggctggtctcgaactcctgacctcaagtgattcacctgcttcagcctcccaaagtgctgggattataggcgtgagccaccctgcctggccagaaatgtgttttcttacagttctggaggctggaagttcaaaacaatgtattgaccaaatgtagtggctcacacctataatcccagcacttttgaaggctgaggcagggggatcacttgagcccaggagttcaagaccaggctaaacagcataggaagaccctgtctctaccaaaaatacaaaaacagctggatgtagtggaggatcacctgagcctaggaggtcgaggctgcagtgagccaagaccacgccactgcaccccagcctggatgacagagtaaagggcgaccttgtctgaaaaggaaaagaagaaggtgttagcagcttgggtttcttctgaggcctctctccttgccctgcagaaggtcaccttctccctgtgtccccagtacctcaaaatgggacggcatttgaagatagggccttgaaagaggtgatgaagttcaaacgaggctgttacgatgggctctcatccaacctggggaaggtcttcaacatatgaatttgggttgggggaaactatgggtattttaaggacaaatgttccttggctgtggatccaggctttaataaaagtcacttttctcttggctgtatacgaactatccccacctttctcttctccttggctggcgtaacaggactcaaagccagtctcgtatctttaaacatgatctctcctttcttcctggaagatcttgaagtttttgaagattcacccttgttgaacaggtacctggaggtgggccttttaatttccacactgagagtatcttttcattcagaaaaggttattttctttctcgttcgtttccttccttccttcctttcctccctccctccctccctccttccttccttcctctctttctttctttctgagtgggggttgcaccatgttgcccaggctgctcctgaatttctgggctcaagtgatgtgtctgcctcggcctcccaaagtgctggaattacaggcctcttttccttttaggaaacagggtctcgctctgccacccaggctggagtgcagtggcacgaccacggctcactgcagcctcaacctcccaggctcaagcaattctctggcctcagcctcccaagtagctgggaccacaggcatgcaccaccatgcctcgctaattttttgtttgtttgtttgtagagacgaggtctccctatgttgcccatgctggtctccaactcctaagctcaggcgatcctcctgcatcagcctcccaaagtgctgggattacaggtgtgagccacggcactggccttcttgactttcttaatcacaattgggtttcgggcccccttttccctcggccactcttatgtgctctctggcggggtgtcctgctgccactggcacctttcctggcttcctcattgctcagacctcaaacagctctttccctctgtgttgggtttcccagtcgctccggtttgcagtgctatcactgcacactcccccttagcagcacgtttctttcttttttcttttttttatgagatggagtcttgctctgtcgccaaggctggagtgcagtggcgcgatctcgatctcagctcactgcaacctccgcctcctgggttcaagctattctcctgcctcagcctcccgagtagctgggattacaggtgcgtgccagcacacccagctgattgttgtatttttagtagagacaggggtttcactgtgttggccaggctggtctcgaactcccgacctcaggtgatctgcccgcctcggcctcccaaagtgctgggattacaggcgtgagccaccgcgcccggcctgagcagcacatttctttttgtctctggaatggatatcaacgcaaccaggttgcttccggggcatggtctcaggccccaccacacacgcagcctctgcccctctctctgactcccatgctcactttggtcctcccccatgagtgctctgctcctcttccccttcccctctttttttcagtccgaaagaggaggcatgctggctggataaaagggagccacatctgtcgcttctgctctgggatctttcatgggagctccagtccacagacatgagtgtccctcgattctgacaaggtgacaaggctcccttcctgtcaccatgcccgggccgaggaggtggctttaccagtggtggggtgggtgacatgatggggacggggagacaagcttccagagggatcgtgcagaatccattcagcaccctggcccagaaagcaagaccatattttccaaattaagcatttagccagctgggcacagtggttcaggcctataaccctagcactttggaggcaaggcaggagaatgacttgagaccaggtgttcgagagcagcctgggcaacgtggcgaaaccctgtctccaccaaaaataaaaataaaaaaaatttagccgggcatggtggtgggcacctgtaatcccagctgctcaggaggctaaggtggaaggatcacttgagcccaggagtttgaggctgcagcgagctgagatcacaccactgcactccagcctggacgacagagccagacactgtctcaaaaaaaaaagaaaacattgagcactttggttggccagattacagaggtgctggctggcagggaccaagggacagcccttggcatgggggtgtcttggaaatcttgcttccctggcctccttgtcgctgggggtggcctgagctccctggcgggttttctgcccacctcctccttttgcatgtccctgtcagctcagacagcagggggcgctgcaggactggctggacggtcgggccagggagtgggagggcgggcctttaagccaaggttcaaaggaagatcgagttactgcaaagaaactgcctgccctgggccagcagccagcaccgagtagttgggtgggagggctttgtaccctctgtcagtctcctccaccctaaagccacgtctgccacgctggggctggccagccacggggctgcagggccctgcaattttctcagatgactttggtggtttcctgtgcagagtggtgtgaagggccctttcatcgttcatcgccctcctctctccactctccttcgcagggtcctgccagcccctcctgctggcctcgggttctgctcacctgccttccccactctggggagcttggcctgccaggctgcggagcctcagggcttcagtcagcgtctctgggatcccaggaccccgtcctcccagcctggcgtgaggggccgagtcctcccatcccccagctgagcctgggcaggacttgggtacccccacttcccactgctccttccagcctgccctctctccacggtgctggaggtgaaagagttaatcacatctgtggcggctccttccaggactcctccaagatatatatttagcaggcggggcggggtggggcgggagaggcgtgccaagatgccctggcaccgcagcccctgccttaccacaccgctcttcggagggaggggcaggcaggcagtgccacaggagccgggtaggatggaggaagggacccatctagatggagggaaggggcaggtacgggagttggctttaagtggctttaaccacagcctagggaaggctgcggtctcagagaggactttgaggccctgtgtgtggggttgggggaggagcttgctctgtatccatgaaagaagggcccagtgactctgtctcccagggatgtcgaaggattgtggaaaagggctggaaacagcttaacggtgaaggtgatggggcagggctggctagaagagcttctaccacctattgaaatggctgggacccctgaccagggagcaccgtgggagcatagccctggccagtccaggtgaccaccctctcagagctgtgctttcattctgggacagcagctctggtgtggccagtggagacaagggcagacaggtttttctatgtcctccttagagattatttccaaggactctgccctcagggagagcaatgtattcagtaggtaaccactaggcgggactggttgctaagggctgtattttgactctaagtggggaaacctgtgattcaccttattccaattcctccaagtacctgggacctctggaggttcagttcacaaggaagacgtttggtttgctcgcttgcttttttaacgggagtgtctgtacccttccctaggtcccaagaataactctgcagatcttggcttcccagcctcaggattgtccccagggaccaggacaaagggcttggtcctattggcttgtctccatggcgcctcccttcttcttcttcccaggtgaatggatcagctcagttagacccaagagagcctcatgcttgtcctagacctcattttcccgacccagtggcattccagccacacctgctgaggccttgggtacctgcgcatcagagtagcagctcctccagctggcagagaaagacttgatttgccacagttagcgcggcccactgtggaagcaatccagggttcgctcaccacccagccatgccagctgatgctgttttgattcccctaaccaggggcagtcacttttctagaactttctgtgtcatgaaccctcaagggaggcagctaatgcaaccctttcccaaagggccctctcctaatacctgcaaattataaggacactatttgacttgatattatttctggaggaaaataaaagtcaataaaggcacataaactgctctgtgatttgaggcaaaatgaatacaaaagccaggcccttctgccacacccactcaccacgtgatcttaagagagtcgtttctaatctcagagtctcagttatcttgcctgtaaaatgtggaggttgagctacattaaatctatggtcacttctcttacccagcttcgtccaggcacggtggttcacgcctgtaatcccagcactttgggaggcctaggcaagcggatcactcaaggtcaggagttcaagaccagcccggtcaacatggtgaagcgccatctctactaaaaatacaaaaattatctgggcgtggtggcgggtgcctgtaagggcaggcgctgaggtgggagaatcgcttgaacccgtgaggcagaggttgcagtgagccccgatctcgccactgcactccagcctgggtgacagagggagactccgtctttaaaaaataaataaataaaataaaataaatgctaccaaacttacaattccccgtgaagcacctaagccttagttcagagtagaagcaggagaaacagagctcactgatgggaggcacctaacagaatacagacagcctgtgagcatctccatgtgccaggcactgggctctgtgtttttttgtctgtttttctttatttagagatggggtctcgctatattgcccaggctagtcttgaactcctggccccaagcaatccttcggcttctgccccaaaaagtgctgggattacaggcataggccaccacacccacctcccaggctcactttctttctttcttttttttttttttttttttggagatggagttttgctcttgtcacccaagttggagtgcaatggcacgatctcggctcactgcaacctccgcctcctgggtttaagcgattctcctgcctcagcctcccaagtagctggaattacaggtgcccaccaccacgactggctaatttttgtatttttagtagagacggggtttcaccacgttggccaggctggtcttgaactcctgacctcaggtgatccacccgccttggcctcccaaagtgctgggattacaggcgtgagccagcacaccccgccaggcctagtttcttatatgcactgtctcattccattctcacaataaccctacgaggcaggaattcttgttatttccattttatacatggacatactgagggccagagagtttaagcaatttgaccaaagaacactagttagtggggaaaacaggattttaatcggccggttgctctctgccttctgtacatctcgccattgtgtgcaaggcatagggagatgctagagttagcagagcctggatctagaaggcaggttcaaggtgaagtcagtcagtcttttgtgtgtctcagcacacaggagcacataccccttaactctaatgctgggagttagataaaaacgatgagtagtttggtgtggccgggacctagtgggtagaaagggggtgatggaagataacgttggaatgatgggctggtactgacactgaaggtcttcatacagcacactgagctcctgatggttcttaagggtatgttctagaaagatcctgctggtggtattagggaggatgaactgaaacatcaggaggccggagaccccttaggaggccagagggatagcccaggcgagagacagggaggccagggagcagctggagggctaccagaagcctctgcagggtacactgggtttggaggagacctgggggcagagggagggaatgctcacaccctctgtggtccctggaacacttctagcaagaaggaggattgtgcaagaggcttagagagagaagcagcagcgctccactctgtcatgacataatcccctaggagatttgagaatgggggcttcagctacccctccccgtgagcatcctgtgtccatgggggcttagccctgggtccagagtttcagaggtatccctctgggctctggacatgtacccagaggtggtcggaagggaagggtgattgagatggacagagaggcactgccctggccggcctggtagcctggccccaccctctgaggctcttcttgcttgggcccccttgccccacttctttctttcttttttttttttttttaagacagaatcttgctctgtctcccagactggagtgcagtggcacaatctcggctcactgcaacctctgcttcctgggttcaagcaattctcctgcctcagcctccatgtagctgggactacaggcgcccaccaccacgcccagctaatttttgtatttttagtagagacagggtttcgccatgttggccaggctgatctcaaactcctgacctctggtgatcctcccaccttggcctcccaaagtgctgggattacaggcgtgagccactgcacctggcctatttatttatttatttatttgaggctgagtctcgctctgtcgcccaggctggagtgctgtggagtgctccctgcaacctccgcctcctgggttcaagcgaatctcctgcctcagcctcccgagtagctgggactacaggtgcccaccaccacacctggctaattttttctatttttagtaaagatgggatttcaccatgttagccaggctggtctcgaactcctgacctcaagtgatctgcccgcctcggcctctcaaagtgctagaattacaagcatgagccaccgcgcccagactccctttgcccttcttctgatgccaaggggcgcagggtcctgtccttacagggctcgagtggctgcatgtgaggaggctgctccacaccagtgtccacgccagagctcggctcagtggcctggaggaagctcccacggtgatgtggagtctccagctgctctcctgcccgtggactttccacctcatatttctggagttctggactctcaccagctcttccacactccctcactcctctactccaacgtggaaataaacagagaacatgaatgagaaggcgcaaaggccatgattcagggcttgctgggtaacaagggggcagccaccaccacctgtgtttgagagggactcaaaggcgggcggggtagggaagctctcgggtggcgtaagccaaaaagtatctgtgacagaactccatcgattcagaggattatttgccaaggtcgaggacgcgccagaggaagagaaacacgagttgcagtaggatctgtggcctgtgctttttcccaggagatttgaggacttcaacatttaaagagggggctggccgcggtggctcatgcctataatcccagcactttgggaggctgaggcaggaggatcacctgaggtcaggagtttgagacccggctggccaacatgacgaaactccgtctctactaaaaatacaaaaattagctaggcgtggtggcaggcacctgtaatcccagctacttgggaggctgaggcaggagaatctcttgaatccaggaggcagaggttgcagtgagccgagatcacgatactgcactccagcctgggcgacaagagcaagactccgtctcaaaaaaaaaaaaaaaatttaaagagggaagagcaggaaggaagggaaggaagaaaggacaaagggagggagagcaggcagcaggggaaggaaaaggaaaagggagggagagcaggcaatgagggaagttgttatgttcctgtgaggctttgattagtactcactgaatccacattttacacaggaaaagaggtgtgcttaataaatatatgttttacgtaagataaagtaagcatgtgagatgacagctggctatttgggaacaaaaggaaggtaagtttttgtttgtttttgtgtgactcagccaggcatgggggctcccacctgttatcccagcactttgggaggccgaggcagggggctcacttgagcctaagagttcaagaccagcctgggcaacatggcaaaaccccatccctacaaaaaatacaaaaaattagcagagtgtggtggcatgcacctgtagtcctacctacttgggaggcttgaggtgggaggatcacctgagccgggaggtcaaggatgcagtgagctgtgatcgtgcctctgaatgccagcatgggtgagaatgagaccctgaaaaaaaagaagaagaaggagaagaaagaaaaaagagagagaagaaaggaaagaaagaaagagagaaagaaaggaagaaagaaggaaagaaggaaaagaaagaaagaaagaaagaaagaaagaaagaaagaaagaaagaaagaaagagagaaagagagaaagaaaagaacagaaaaaaaggaagaaggaaaggaggggaggggaggggagggggaaaggaaagggaagcttcaggtttaccttgatggaggctgtgggcctaggaagctggaagcagctcactagaagaggacagggcatcctatgggattggttagaggggcatacttggctttacttttttttttttttttttgagacagtgtctcactctgttgcccaggctggagtgcagtggtgccatctgggctcgctgcagcctcaacttcatgggctcaagcaatcctcccacctcggcctcccaggtagctgggactacaggtgtgtgccaccacacctggctaatttttatattttttgtagagatggggtctcactacattgcccaggctggtctcaaattcctgggctcaagagatccacccgcattagcctcccaaagtgctgggatcataggtgtgagcccctgcatccagcccatatttggctttttcttggaaatggggataaattggaagcagggatgagaattagggaaactgtcgattacaaatcaagtcctggccaagtggagtcaattggttgacttcttggaccagtcattagaactgatcgcctgacttccgcaagtatgacttgtagctagcagacagcaggctggcttcctgggctggtcgttgtagaggatggcggggcttcctgggctggttgctgcagattgtgggtcagagatctatttttatgtctggtctggccgctggccatttgtagagtcagtctctcaccagcaatctgtgattatcatcctagtttttcagacaagtaaactgggaatcagaaaagtgagctgacgtagctaaggtcacagaactagtaagtttcagaacctggacaggaatctgccggtctcagccttccgcaggcaaagttcacagctgactcatttttgcctccttgtctcccactcttaattaccccagtactttgggcatgttctcaataagtatttattgaatgaatgaatacaaatttttatgacgtcagtgaggaaaccagagaggaaagccagaagagagtgaggggtcttcgctgaggaggcccctgtaatgagaacgacgccgctgggttctcttggccacctcttctctggcatcctgcaagaatcccaggtccttggttggagcctggaaccactggctgagagacttgtgggtctgggccagcttggccaggagggacctggcgttggtttggaagggtgagagtcgggggagcctgcaccccacggggttacattgttataattaacatactggggacggctgtcggatctcactgagaggaggggcagtcaatggtggggaagggcacttcctcccaggagccgcctggggatccaaccaggtggggagggtcaggagcctcaggcactacggaaggcagaattctaagcccgtcccatggactccatccctgtccccagagttactcccttgaccatattatagggctacacagtgaaagggatttatggtgtaagaacggtaccccagggaaacagcggtggctggggaggtcaggtggacctggggggccaggtgtccaggctgcctgtcccaccatgtcccggactggcctcatggccctaggcccctccctaagccccagtttctacatctgcgaagtgaggcgctggcccaagtaatctaaccctacctgttgtgatccagattcttttgagccccagggaggccaggattaaggccggctcccctgggttccagccgatcaggggagtgtgggtggtttctcgggcctgtggaaggaaagaagccgaagaaatcactcttgaaaagtggccgctatacgagcgggctggctgggtgatccctgtggcattctggtccctctccctcctgcctcagttcctctatgacctcaagatggaagagccacacctacaaagaaaaaaagactatctgtgagaaacaggtgtgcgtgttgatttttccaagggcttggctcagctttgggctgaaaatccccaggccatccacaaggggtgtggtcacaacccaataaagacttcagtctcagagcctgggaccatcccatcaaccacaaaatattatacaggaggagcatgagccagggaggggagttggcccctcaccgcccccacctcagtaggtggcccttctgactctgcgctgctgctgcaggagatggcaacacgagggtctccgcatgcagcctgcaggcgtctcagcttcatgtcctcagcctcctctcttccttcttttctccagaaaggaggccagcagaaggcttgggccctgaaagctaaagggaaaggaatgcaacctgggctgggcaggagcagaaggagagaggaaaacagtagagggtttttttgttttgttttgtttgaaacggagtctcgcactgtcacccaggctggagtgcaatggcgcgacgtgatctcagctcactgcaacctcctcttcccaggttcaagcgattctcctgcctcagcctcccaagtagctggaattacaggcacctgccaccacccctggctaattttttgtatttttagtagagaaggagtttcactgtgttgtccaggctggtctcaaacacctgacctcatggtccacccgcctcggcctcccaaagtgctgggattacaggcgtgagccaccgcacccagccaacagtagaggtttgaagatgtgaagatggagtccctgggagaaagggggccttagtggtttagaagccagaaggtttagaggaaatgggatgaaaacatgcaaaaacgaaggagttgcgagacaaaatgcttccctgacagagctgcttggttggtaacaactcaaatttggcaaaaggcaccttggtttcatcctagcatctacagtgcttatggtccttactgggaggagagggagccaggtccagaaccctctgttgcctctctgaggttctagcagcagttcccaggctctctcctccaggctctggtcaatcggataccttcctttggcttcgaaagggcagacacatccagccacaccagtcttactgcccttgctgtgctaaatcctgtccagctgacaccgcagtttctgggccccacggaatcttggctccccgggctctctgaccactcacaccccttgttcctgcagacagtcctgccatgcctcttgctatcccagagggaagaaaaggccacaagaccaagtagttgactttgcatgggagtttcgaattaagttgtttgactgcaaagaggagggcccttttcaaatcttccaggacctgaaactcgacaaggaaggggaatgccaaggttgagtctgagatatcagctcatgagccagaaggagaagggagctgcgcaaatggttgttctgctcagtggggccccagggcgaggccctgcagctaagaaaacgcttttggtggttttcgctgcaggtgcctacattcttgtgtaactgtaggggagaggggcctgggtgaggggagaggaggctcccgcttggccttgctacaaataatagcattgaagggagctagaagcacgttaagcaaagccctggaaacgcgttaagggcagactctcaaggaatctggatgcccacagccaggcaagaggccaggttgagagatggttgtgggatgccccgtgagcagggtcctccccctcctctttgccctgccctaccctgcccaatatcaggctatctgcgggggacaggccaggagctgcctctctgggctgggcaccatctgggtggccaggaggtgagcccgggaatgcccaggaagagccaagtcctgaagtcactgtgcccaggcctgcccttccctaagagggggtatggggggagtggggaggcaagcaggtgggagattggagaactccaaggctgtcttcagggcatgagaccagagtttgagggtgggggagtatcagggaggcaggttggggccattagtgggtgagatccctggtagtgggaccaggcaggctgtatttatcccgtccttccttccttccttccttctttccttcctttctctttctctctctttctctcccccttccttacctccttccttcctttctctctttcttccttccttctttccttcccttcttttactttttccttcccttcttctttctttccttctctcttccttccttcattccttcctttctttctttctttctttctctccttccttcgtctctcttctcttcttattttcttcctccttcccttttctttctttctctcttcctttccttctctgttccttccttccttccttctttccttcctttctctttctctccctcttcctctcccccttccttacctccttccttcctctctctttcttccttccttctttccttcccttctttttctttttccttcccttcttctttctctttccttcccttctttttctttttttctttctttctttcctcctctcttccttccttaattcctttctttctttgtttctttctttctctccttccttcctttctctctctcctctcattttcttccttccttcctctttctttttctttctcttcctttccttctctcttccttccttctttcattcctttctttctttctccccttcctttcttccttccttcctttcttctctccttattttctttgcttttttttttttgttttttttctttttctccttattttcttccctcctctttctttctttctcttcctttctttctgtttttatttttatttttattttttgagctagggtctcactttgtcacccaggctggatggagcacagtgacacgaccacagctcactgcagcctccacatcccacctcagcctcctgaatagctgggactccaggcacacgcccccgcacctggcgaatttttaaattttggtagcaacttggggtctcactatgttgcccaggctggcctcgaactcttgggctcccaaagtgctgggattccaggtgagagacaccgcactggccaccaggctgtatttcttttgggttcagagtgctccgcacagtcttgagccccctcttcaggatgtacggtctccatggggctctgagggtgtttgatgaaatgtacaggaagccattggcttgggctgagctcctgcacgaggcccagcagaccaaaccgaaatggaatcattcatgctgaagttctgcgtcacccagctgacactaagttgtttatctgacattctgagacatcaggagagtgagggataatagccagatccccaaacaggccagttttagccagcatgataaggaagtcccctctgctttaatcttacaaggaaaataactttgaaatctgatgtttgttctgtttctgctttcaaagccaacctctactgctcagctcaatccgaacactcattctatagtgtaaggtgagatattgcccaattctagaatccaagtaaaagccaattaagatctttaaatttgttgtaattttgtcttttgacaagagaaaggagctttcagggggaggggccatttcctctctgtctctagatctcctgtgtatatgggaagagctgggaccaggcccagcaattacctcaccatggttgggtgcaaccaagtggggcaactctttggccagaaagcaaaagtctttttagcttcaatgtaggccattctgggtcccagacccacagctttggacattatgggaatcagaattcttagatggcttcacaatctctgtccctgggtgtgttactcccttgatgatattatattatatggcagaagggatctgcagtgtaattaacattaccaatcagttgatctccaagtaggtcagttatctgagtgggctggatctaatcccacgagcttattaaaagcagagagtttctccaatagcagaagggaagtcagagagattctaagcacaagaagaatgggatgcacgttcactggctttaaagatgcaggaagcattacatggaaaggacttgtgaacagccccaaggagctcagagagacgcccagccaacggccagcaagaaaacaggaacctcagtcctgcaaccacaaggaagtgggttctgtcaacaacctaagtgaacctggaagtcgattcctccctagagcctctggatgagagcccaggctgaccaacaccttgattttggcttcctgacatcctaagcagagatccagtgaagcctgccccagatggctaacctacagaaccgtgagcaaataaatggctgctaaatttgtggcaatttgttatgcagaaataatacctaatacaggtgcctgcacagtgaaggttccagggcatggatgttgatcccaggggaggaggcaaatgaggccttctgatttctcccacagccttgaaattgcagcctcaccctgcactctggctgtgcccctcctccacagagaaccgtccacatctttgctcgcacggtttctgccagaggcccaagcttctgtgctcaggctgggaagtttgggcatgaactatgtacagataaaccaattgcaggggaatcgcacagcttcttattatcattatccaggtttcttattagttttcttctctgttaattttcccctgtatttctgcccagttctgatgctgttggatcttccaatccttggcaaaaggaaaatcctttttagcaagttactcaggcaggactccctaattaaagacccagagtggccaggcgcggtggctcgtgcgtgtaatcccagcattttgggatgccaaggcgggtggatagcttgagcctaggagtttgagacgaacctgggcaacatagggagaccctgtctctacaaaatataaaaataaattagctggtcctggtggcatgcacctgtagtcccagctcttgggaggctgaggtggaagggtggcttgagcacaagaagttgaggctacagtgcactatgatcatgccactgcactcccgcctgggtgacagagtgagaccctgtctcaaaaacagaaactcaaaatgacttgctctctctcccggtcttgtgacctaaatggcttgatttaggacgtgtggcagagatggttagctgtctaccaaaatctgcacacccctttcatagcacagtattgtcactaagagcagagactacatttcccagctgcctttgcaactgggtgtgtccacgtgacaaattcctaccagtagaatgtgagcagaaaagctgtgcagcccctctgagccaaggcatcagaagcaggtgtgcttcctccatcacttccctcctctttgccagctggatataggtaccaacgagaccctggggaaggggagagccctgagatggaaggagcctgggtccctgaatcaccacgtggaggaaagccactgaccaatcaggaacgctcgtcttggtctgttatgtgactaagaaataaattcctaaggtatttgagctattatacatttgggagtctatctgtgactgctttttagcttacccttcataatacacatccctctttggcccccagtgtaaatcaagttgcacaaggtgctgactaaactcccaggatgaaaaccttcaaatatccctgtacctcactttcctcggctggctcccatccctgtcttggttcacactgcttgctccaaagtctggctgactcagctggcctgggccatcatccatctgctgtcaaagagtgcctggctcacagcaaaaagaacatttattcccccaaaacatagggttctttttttcagcaaaggtggtgcagcaatatatttggagacgcagactgcgagtcagcacatgctcccggttcccttgggacacagtcagggagctcatgtcttcagccccagctcccccagcaagagcctccagtggtcggaggagaggagagaagagcagtggagagggggaggaaagcagaaagaggtgacaattctctcagaaagcaattaagcatttcgtggtggccccagggacaacctcaactttttgtgtttttcccccagagagactgaagaactggggggaggagagcatccctagctacagttattgaaaactctgcttggtaatgtggcattgagagactctgagaagctggcttcaggaaggtggccccacactgcctgcccaccacctgggatgccacctgccgcaacggtgttggtctctggtcagggctggggtaaagatcagcagtggctcatcttccctctgacacagcagcatgggacacctggatggaactgaaatggggtcccagatacagcaaacctctctccctgtccacttctgaagtccagctcgggattgccggccccagcagagcaggcaggggagctttgactgtggatggtgtttgagcctagactaggccccagggtcttcaatgaagctcacagatggaaaagcccagcaaccaggggtcagaggccctggaagttagaaaattacaagtccccatccttcaaggagctccaggatgactctgcctcagcaatttccagtgcaaatttactttttgtttgagtcaggaaataacaggctgcagactccctaggggcccaggaatccagccaccagcttctcctggcttctctcatccttccgtgagcaagactcagccagacgtacagggtggccccgagcttaaattacaaccacctgaccagagctgccccgcagatgcccagaccctgcttagagagggtccctgtggagagaggggcttccccaggcctctggctggtcgcatgcgtggcctgaattctccatgcacaggcaagaggctgtctctacttcccaccctaggcaactcttagcactaaccctgaagtgacgatgagccacggagccagggtggaagctacacagtgcgtctcacgtgacttccagtgagagctgttcccaagtttaccatccctcggcggtggctcaccaccctctctgcccaaagtcctctcaatagcctaagtctcttccctccactcagcctcattgctctcattttgtcacttagagcttagtgacattttgctttcttccaaatcctccttcttgcagtctagctgggtcctttcatgcctagtttacaaagatgtctggcctgatccctatctgccagcccctatccctcccagggggaccaggaagcctgggtttgacaggtgcaatgcacaggtgccgggcgcccactgggagtgcaggaggccaaggtcttcccaggactggcagctcagatggcccaggcagaaataacctgagcctgctgccctttccttcttgggagtgactcagcgagaagccggaagatagaaacacaaatctggtcctggatcttgcagagccagtcacaggcaaggccacagccttaaggctgtgtacggagaggacctggagccagccatagggctggacgctgaaaagacgctcaacctcatttagcaggagacaagtgcaaatgaaaactatacccagaccccattttccacagagcagattggcagagatgcaagctttcaggacacactcacttggcaagaaggggaggccattctcccgctttgctagcaggctgtaaaatgatacaatctcctcggaaggcaagttggcaatatctatccactaagtgcacaaattctttgacccagcgattctacctgtacaaacggaacacctagctatgcgtgcacatttatgacatgacccaggcagcattgtttgtaataatgacaaaggattggaggctcctacataggtgactggttccacacttgcggtgtccccatgcgatggatcacagtaggcagaacagataattggaaccattgatggacgagtatggaaccgtgtcctagatacattggaaagaggaaaaacaaaacaaaagaaattgaggagcagaacgggctgtggggctggctggtttcaattctcgatgaatggatgaaatggcacactcccatttgggtaaaggagggtaacagagaagcaatgtctatgctggtctaatgtgtgtgctaaggaatatctccggatggataccccagattggtttcattagctatacagaggcaagcatatacctttttgtaacttgagcattttaaaatatgttagctgggccgggtggcacgtgcctgtagtcccagctacttggaaggctgaggcagaagaatcactcgaagcctggaattcaaggctacagtgagccatgatggggtctatgaatagccactgcattccagcctaggcaacacagtgagaccctcatctctaaaaacaataaaaattcaaaaaatttttttgaactaggcaaacatgttacttattttaaaaaaataaacagtttaaaaggtgaggccaggcatggtggcacacgcttgtaatcccagcactttgggaggccgaggcaagcagatcatgaggtcaagagatcgagaccatcctggccaacatggtgaaaccccgtatctactaaaaatacaaaaattagctgggcatggtggcacttgtctgtagtcccagctacttgggaggctgaggcaggagaatcgcttgaacccgggaggcggaggttgcagtgagccgagatcgcgccaccgcactccagcctggcaacagggtgaggctctgtctcaaaaaaaaaaaaaaaaaatggtgaacccctggctcggtaatggaataaaatgacaccagtacttgagaggcaagcaagttccaggatagaacgaggtggtggagggaagcgatcattccattttacattcatattttgcaaacagtttctccttttctgttgctgctttcaatccagaggcagtcctttcttttcagatgaagaaatggaggctcagagaggggaggtgactttgtggaagtcacacagcaagtggctgagccaagactcacaaccaggtatttttgttttgttttgttttgttttgttttttgagatggagttttgctcctgttgcccaggctggagtgcagtggcacgatctcagctaactgcaacccccacctccctggattcaagcgattctcctgcctcagtctcctgaatagctaggattacaggcacccgtcaccacatctggctaatttttgtagttttagtagcgatggggtttcaccatgttggccaggctgatctcgaactcctgacctcaggtgacccacctgcctcggcctcccaaagtgctgggattccaggcatgaccaccacacccagccttgttttgttttgtttatgagacagggttttcctttgtcacccaggctagagtgcagtggtgcaatctcagctcactgcaacctctgccgccagggttcaagcaatcctcctgcctcagcctccctagtagctgggactacaggtatgcaccaccacacccggctgatttttgtatttttaatagagacagggtttcaccatgttggccaggctagtctcgaactcctgacctcaggtgatccttcagcctcagcctcccaaagtgctggaattataggcatgagccaccaggcccggctgcatccaggttttcgggctccccatcacatggttttttctacctcactctatagcagacaagacctggggtcttgggtcactgctatccccatttccacctagaacatgatctagaccacagtacatatgggctcaggaaccagctgtcagagaatggcgtcagattctagctcagctacatcctacctgagtgacttttaggggagttactttttggactgtgctgtggtctgtttgtgccccacctaaattcatatgttgaaacttactctccaatgtgatggtattaagaggtggggcatttgggaggtgattagtgctcttataaaagaggctggagtgctgggtgcggtggctcatgcctgtaatcccagcactttgggaggctgtgacgggtagatcacctgagattgggagttggagaccagcctgaccaacatggagaaaccccgtctctactaaaaatacaaaattagccgggcatggtggtgcatgctgtaatcccaactactcaggaggctgaggcgggagaatcgcttgaactcaggaggtggaggttgcagtgagccaagatcgtgccattgcactccagcctggacaacaagatgaaatactgtttcaaaaaaaaaaaaaaaaaaaaaaaaagaggctggagggagcttgttcacttttgccctgtgaagacacagcaagaaggtgctatctttgaagcagagagtgaggccaggtgcggtggcttatagcggtaatcccaacactgtgggaggctaagaggagaggatcacttgagcccaggagtttgagaccagcctaggcaacatgacaaaaccctgcctctacaaaaaatcccaaaattagccagatgtggtggcacatgcctctattagggaggctaggttggagaattgcttgagccccaggaggttgaggcggtagtgagccgtgatcacaccactgcactccagcctgggggacagagcgagaccctgtctcaaaaaaaaaaaaaatttttttttcctttttcttaattcacctccccttccttatttctatttacttttaaatattaatatatagtaaaactggccaggcacagtggttcacacctgtaatgccagcactttgggaggccaaggagggcagatcatttgaggtcaggagttcaagaccagcctgggcaacatggtaaaaccctgtctctactaaaaatacagaaattagcctagatgtgatggtgggtgcctgtaatcccagctactcaggaggctgaggcagaagaatcacttgaacctgagagatggaggttgcagtgggccaagatcgcaccactgcactccagcctgggccctgggtggcagacagagtgagacactgtctcagaaaataaaaatatataaatataaataaataaataaaattaatatatagtaaagttgatttttgttgttgttgttgtttcgatttgcataatcaccttcacaatcaggatacagctagttccatcgccccaagaaacctcctcaagagtccccttcagggagccacattctttccccaccccagcctctgcctagaaatggctaacatgttctctgtaattttgtcttcttgagaacgtcatagaaatggacttttacgtgatataaccttttgactggctcttttctttagaataatgcctttgaggttcatcgcaggtgttgtgtatatcaatagttcatttcgtttaattatggggataccatagtttgtttatccattcattcattgaaggacatttgggttgtttccagtttttggtgattatgaatagagctgctatagatatttgtgcagaggtttttgtgtgaacaaaagttttcatttctctaggcagtaattctcaactggaggcaatttcgcctcccatgggacatttggcaatggctctgacatttatgattgtcaaggcgaagtgctgctggtatctagttggcagaggtcacggatgctgctaaacaacctataatacataggacagtccctacaacaaggaatgatctggcccaaaatatcaatagcactgaggctgagaaaccctggtcttgggaatacacagaactgaagttgttggtcatgtggtatgatatggtttggctgtgtctccccacccaaatctcatcttgaattgtagttcccataatccccatgtgtcatgggagggacctggtgggaagtaattgaatcatggaggcagttagccccatgctgctgttctcatgatagtgagcgtgttcttacgagatctgattgttttataaggggctttcccctccttcgctctgcacttctccttgctgctgccatgtgaagaaggatatgtttgtttccccttccgccatgattgtaagtttcctgaggcctcccgagccatgcagaactgtgagtcaattaaacctctttcctttataaattacgcagcctctggtatgtctttattagcagcatgagagcagactaatgcatgatacgtgtatgttccactctataaaaaaattgccaaactgttttccagagtgactttaccattttgcatttccaccaacaatgttgaaggttctaggtgctttacatctttggcagtgtttgacattgtctatctttttaattttatccattatactagacatgtggtggtatctcattatgcctttaatttgcatttccttaacggctagtcatgttaaatatcatttcatgagcttatttgccatctgtgtatcctctttggtaaagtgtctattcaaatcttttgccccttttaaagttggatttctttatttcttactgttgaattttaagggttctttatatattatggatgcaagtttctttgtggaatatgtgatttgcatcttctctcattctattgtttgtttttccattctcttagcagtgtctttcacacagcaaaaatttttaattttggtgaagttcaatgccttactccattttgtgctgttatagatactacagactgcctgggcatggtggctcacgcctctaatcccagcactttgggaggccaaggcaggcagatcacttgaggtcaggagtttaagaccggcctggccaacatggtgaaaccccgtctctactaaaaatacaaaaattagccaggcacagtggtgggtgcctgtaattccagctactcgggaggctgaggcaggagaattgcttgaacctgtgaggcagaggttgcagtgagctgagatggcaccactgcactctagcctgggcaacagagcaagactctgtctcaaaataataataataaaagttaacatttgaggaaggtgtgagatttaggttgaggtgcccccccccactttttaaaatacggatgtcaatcattgcaaccatgtgttgcaaagattgttctccttcattaaattacgtctttgtcaaaactgatggaattgacgtctttgtcaaaaatcagttgggcttatttgtgtttggtctatttctgtgttctctagtctctctcattgactgctggcctctacccatttgccaataccacattgtcttgatgactgccacttcaccataagtcttcaagcagagtagtgtgattgtaagtcctgttgctttattatccttctttatcaaaattgtttggtttttccaattcttttgcccttccgtagacattttagaatcatctatctatatctacaacctttccttcttcttcttttttttttttttttgggacagtgtcttgctgtatcgcccaggctggagtgcagtggtatgatctcggctcactgcaagcttcaccccctgggttcacgccattctcctgcctcagcctcccaagtagctgggactacaggcacctgccaccacgcccagctaattttttgtatttttagtagagacggggtttcaccgtgttagccaagatggtctcgatctcctgacctcatgatccgcccatctcggcctccaaaagtgctgggattacaggcgtgagccacccgtccagccaacctttccttctttttaacttatttttacgaggcataggcttatgatgaccccattttactctttgttctaagtaggattttgacactcagagttctaggtagaacctttgggtaggttccaaggaagggagaaatgctgcttttatagaaaactcaaaaaaaaaaaaacagccattcacctgcttcttgggagaacagattgccttttgcctaaggaacatgaagtgtgcagatttgctttcttttctcactgtggagctggtctgtgcattttgttctccactagtttgcaaggccaagttatattcactttttttgacagcaaaatggtaagaacacttctgactcgtcttggaagatattatttatccttctgaaacatgtttttcatcaggtcaaataacttgcctgaaactgctcatacaatttcttctaaaagtggagcaagagttcatcttgtcttgttctgggattgtcagatctgaacacattgccctccaattctctggtttctagaacagacgaggctgccactcaacaccaaaactaagagaaggattgaagtgagtgggaatcactaaaagagtcctactggccttcttcctgggactggggagccagctgtcctttgcccctccactcccagctccccggtcctggacctgggaagactcccctgctccggccctccctgcatccctgagaggcctggagagcagaggcctctagagctggtcgctgtcttgtttactacctgaaaccaggcctctgagttttctgcttgtgcaacaagacgatctgcttgaggaagagaagtcatgggccactcattaagacagccagtcccaggggaaagagaaatgggtgaggcctgggatgtaggagctccttctggctctgtcgctggcttactgctatacctgggacaaagaatgacttccttaagcccgttgtgctcacctataaactggcaactatgcgatctgacctgctcatctcatggaattgttgcaagactcaaatgatcaagcaagttttctaggaaacatctggaaagaggcagcccaaactgttcagaatggcttctctagggaagaggatatgggagcgaatggagagaactgcggttattccgcttttgtcttcgattaattctgatcttgtttccaaatgttttaacaaatacggattccttttgtgattgaaaaagtttgtaggccaggcatggtggctctcacacttgtaatcccagcactttgggaggccgaggcaggaggattgtttgagcctaggagtttgagaccagcctgggcaatgtagcaggaccccatctctaatttgaataataaaaaataggccagcacggtggctaatacctgtaattccaacactttgggaggctgaggtgagaggatcccttgagctcagtagtctgagaccggcctgggcaacagagtggaaccccatgtctgtaagtaattttaaaaattagctgggcagtcgggcgtggtggctcagcgtgtaatcccagcactttgggaggccgaggcgggcagatcatgaggtcaggagatcgagaccatcctggctaacacggtggaacccccgtctctactaaaaatacaaaaaaattagctgggcgtggtggcgggtgcctgtagtcccagctactcaggaggctgaggcaggagaatggcatgaacccgggaggcagagcttgcagtgagccgagatcgcgccactgcactccagcctgggcgacagagcgagactccgtctcgaaaaaaaaaaaaaaattagctgggcatggtggtgcacacctatagtcccagctacttgggaagctgaagtgggaggattgcctgagttcaggaggtcaagactgcagtgagccttcattgtaccactgccctccagcctgggcaacagagcaagatcttgtctccaaaaaaaaaaaaaaaaaagtttgtaaatgttcacatgtatgttaatgtaataatgtgttttgtggtcttcaaaagtctccagccctgctaagctgccagttacccttcttagcctgtgttgtgggttgcttagctcagagtcgcttgcttcggtttcacagcatgatgggctgagcccatggatatctgaaacctgagggtgttgatgaaatcagctaggatgtggacctgggttgaggtcccctccatggcttcctgttgactgtgagtctggctcctgcctccttcctctgagcctcccaggcatggagcatgtgtttctccctggctatctggccagcccagcctgcaggcaggcactgtggtgccagagagagcgctgctgctgaacagaatagagtcagcacaaaacacattaaaaaatcaatcgctgggacagcagcccaccagagaaagggacctgggcgcagaggccatcctcccaaggagctggtgcagctgggggctcagggcatgccaatggctcagcaggtgcagtggccagcctggccagaagtactccaggcacaaagacacagccagaggctggcacaacttcaccgggcagcaaggagcaatggggtcgtgtgcctctatacgtgtttagttgctgtttggaagccgcttgcaggtggaatgcgtgttctgatctccccatgtggctgagatccgtccagggcaggccttcgcttccccagagcccctcccacatctgagaaaatagctgggggtgccgcccgtggagaacccaggataccccagtagcaagaaaaggcacccaagaaagagaccaccgctgttcctaatggggcagtcctgactgtcactctgaccaatgacaggagggcagaacccctaggacctctctctgtggagtggggagagagggcagggacggcagggagcccagcctctctagccagccccaccaaccaggtcgcattcacagatgagctcattaggggctcactcaggaattcacctcctgcccccaggctctgcagacatttatggtgggggtaggattcctgtgtgctgaaaacaaattctgtcctgtcctcctaccactacctggacctgcgggggagggggcacaagttgtcctgcgctagcggctgtcccgagcctcaggggggctacagctgctcagtgagcagggtggcccctgagaaggagtgaggaggacccagtcctgagtcagcaccactcagacccccaccctgctcccctcctgaacaagttcagcacatggggttgggacacagacacaaataccccatccaacgaactctctctgattggaaacacaaatctctcccctcttccatcaggatcccagacagaaaccatctcatgcagagagcatcctgaggccccacctcctccccagttcagggctcagcaaactttttctgtaaagagccaaatagcaaacattttcaactacattcgtgaccatgtggtccctatcactattcaactctgccagtacagcacgaaagcagacagacaataaggcaacaaatgggcatggccacgttccaataaaactttatttatacaaacagatggcaggctggatttggtttgtggactgtagtttgctgacccagctgtaattcaccaggcacgtcctagggcaggtctgagcaccctttaggatcagccgtcctcccaaggagctgggaccacagatgtgtgctaccatcccggctcatttgtttattcttttatttttatttatttaattttttgagacagggtctttctttgttgcccagctagggtgccatgacatgatccctgctcactgcagcctcaacttcccaggctcaagcaattctcctgcctcagcctcctgagtagttgggactacaggcacatgccaccaaacctggctaatttttgtattttttgtagagatggggttttaccatgttgcccaggctggtttaaaactcctgagctcaagcaatctgcctgtctcaatctctgaaagggccaggattacaggcatgaccaatcatgctctgcctgagtttgctctttttatccccattttacaggtgaggaaactgaggctcagagaagcaacaacctgcccaagggcacataaatttagctgtagtcaaaaggaaaacacagggccaggcgccgtggctcacgcctgtaatcccagcactttaggaggctgaggcgggcagatcacttgaggtcaggagttcgagaacagcctggccaacatgctgaaaccccatctctaccaaaaatacaaaaattagccgggcgtagtggtgcacacctgtagtcccagctattcaggagggtgaggcaggagaattgcttgaatccgggaggcggaggtggcagtgagctgagatcgcaccactgcactccagcctggacgacagagtgagactgtatctcaaaagagaaagaaaaaaaaaaaaggaaaatatgaaagccaatatacaagaagaaaaggacaggagtgggtgaggcgccttgggaggctccacagacaaaaggcaggtaagaagctgtattgggataactatggcttcatgttttccagaggaagagggggcagtgcctctgagccaccacgggctcagctgggggcctgggggcctgtctcttgcacacctgccgggctttcctgggaagctgacggcccttggtggaaaggttccttgggggtttgtgggatgagcatcccagtggctgcataaggggttgggtagcgtcgctcactatttaatagtctacctggaatctcagaatgtgaccaatttggaattagggtctttacagatagaattaaggtaagggccaggtgcagtgcctcacacctataatcctagcactttgggaggcctaggtgggcagatagctcgagcccaggagtttgagaccagcctgagcaccatggcaaaaccttgtctctacaaaaaatacaaaaattaggcaagtgtggtggtacacacctgagtcccagctactcaggaggctgaggcaggagcatcgcttgaccccagaaggtggaggctgcagtgagctgtgatgactgtgtcactgcactccagtctgggcaacagagtgagaccctgcctccaaaaaaaaaaaaaaaaaaaaaaaaaaaaaaaaaaaaggtaaggactgagataagatcatacaagattaggatgggcccaaaattcaatgagaatgtccctataggaaccaaaaaaggacatagtgagacttacaggagaaggccctgtgacaatggggcagagattggaatgccaaggattgctgggagtccccaaagctagagaaatggaacagattcttcctaggcacctccagaaggaacctaccctgcccacaccttgatcttggacatctggcctcagaactgtgagaggattgagaggataaatgtctctgtctctgaagtcacccagtttataggaatttctttcatcagtgacaggaaatgaatattttatgtgtgaactttggttttttgttttgttttgtttctttttgagacagacatttgctctatcacccaggctggagtgcagcctcctgaggagctgggattacaggtgtgggccaccacatctggctaatttttgtacttttagtggagacaggtttcgccatgttggccaggctggtctcaaactcctgacctcaggtgatcttcccgcctcggcctcccaaagtgctgggattacaggcatgagccaccatgcccagcatttatgtatgaactttggagggtggttcccaatgtccctggttcccagccactctgaggtccccagtgatgattgtagagtgagagaatggacagagaaagggacaaataaagagagaaacagctggcggggcagggaatagcttggaaagccggggagcagtgccagtttaagggaagccactgcagggggccaggaggggggcgaggccagaaaacacacagaagaggtgaggctggctgtgcatggcaccggctcctctaggcctgagaaatgcaaacaggcagagctgtggccagttctttatccaagagatagccagttcaatgaaaggcttatttggacggctttggcgcctgtgcctgcacagaggacagtcagaagccacccccatgaaaccacccaactgcctggtcagggctgtggtcaggatatgggagggaggccaggctggatggtggccagggacaggactctgtatcttggccctggtcttggtggcccagggctctaatccccattgcaccaggcaacccagcagcatctggagagctggggaggggctaaggttgctcagcggcttttcttttcaggggtctccgctgctccccacactctccagccaaagccaggacccctacattgtcacagtgacaaaccttctaacctgggcagctcaggaggcttaggagtgggactggccctcattctgggtggtagcgggcaccacttcctcccctccctgtcactgccccattgatgggtagagtccctttctccaccaccccattcaatctgggatgtcttgaccaagagaatatggtggtgtcagcatgtgactctgtgccagatgcgccgggaggcctggagaggactagcaatgtctacctgcttttgaagccaggagcttacatttgtgaagcctggggctgggtgcagtggtgcatgcctgtaatcctagcattttgggaggccaaggcaggaggatcatttgagtccaggagttggagaccagtctgggcaacagtgacacctcatctctacaaaaaataaacaaaattagctgggtgtggtggtaccgatttgtggtcccagctactcaggaagctcagacaggaggattgtttagacctggaaggaggctgcagtgagctgaaattatgctactacactccagcctgggcaacaaagcaagaccctttctcaagaaaaaaaaaaaaaagcagccccagccaggctgtactgctgagaggccacgtggaggagccctgagtcaccaccttggacacccagcctggttgagccttcagatgaccacagccccagctgctatctgcttgcaactacccagagatccctgaggaagaactggccagttgagccccatcaacccacgcaaccatgagagagaaaaataaattgttgtgttaagccactaagttttggggtagtgtgttcacacaactgttccctttcccatcctcattcactggctacttcggggccacaaggacccccaagctccagaatccatagtccctcattaatgatttgacctagtggtatccctggtgagaccagcctgggtggcagggtagagttgctgggtggcactctttctggggttgatagaaatatttacattaaaatccataaatatttgtaaaacggctggatgtttgcagcactctgaggagtaaaacagcacacaataccttttatttgaagagcagtaatgagtgtttcaagcactctaatatatttcatcacatttcacccatgacaaccatgaaaggcagccgggcaggcatcctcccttttatgattgagcaggaaactacattaagaccacacaaatagaaatggcagagccagggctggaagccaggttgtctggctaccggtccgcaggcctcctttccctgcatccctattgtctgcaaaccatctggagagcagttttctttttttctttttatttattatttatttatttttcttttcttttcttttcttttcttttttttttttttttgagacggaatctcgctctgtcacccaggctggagtgcagtggcacaatctcagctcactgcaatctctacctccagggttcaagcagttctcctgcctcagcctcctgaatagctgggattacaggcaggtgtgccaccacacccgtctaattattttgtaattttagtagagacagggattcactatgttggccaagctggtcacaaactcctgacctcaggtaatccatccacctcagcctcccaaagtgctgggattacaggagtgagccaccacacccagcctatttatttattttgagacaaagtctcactctgttgcctaagctggagtgcagtggcacgatctcggctcactgcaagctccgcctcccagattcaagtgattctcctgcctcagcctcctgagtagctgggattacaggtgtgcagagctaattttttatatttttagtagagatgaggtttcaccatgttagccaggctggtctcgaactcttagcctcaagcgatcagcccacctcagccacccaaagttctgggtttacagccatgagccaccacacctgaccttattttatattttagagaatggggtctggctatattgctcaggcaggccttgaactcctgggctcaagttgtcctcctgcctctgcctccctaagagctgggattacaggggtgagccaccacgcccagctggagagcagttttcgactcggacaagccccctttcccgggctggaggaaggacaggcagtagccatgagccctggagtcaacttcctggatccagctgtggctctgcccttagttaggataacctggcagctagttactgaagctgtaaagggagatgccatttatccagctgtaaacggagattcactgctggagagagctctactgctgagacctggtgaaccggctcctctaggcctgagaaatgcaaacaggcagaggacaggctttgggggctgcctcaactgacagagcacagcggaagtgaccctctgtgatgctgaaagccagatcaaagaatgtgtggtgtctgccttgctctccaggaagcagtcggacttccctaaggctgccacacactgaggaagccctaactagccacagggagaggccctgaggccacataaaggaaggaggacacacagatgcctgcctgtcccctgctacctcagccccatgctgtcccagcagcgtgcactgcctgactgcacctgtctgaaagacccagagctctaacctggtctctacaaaaaacaaacaaaattagctgggcgtggtggtgcatgcctgtagtcccactactcaggaggctgagacaggaggatcatttaggcctgggagaaggctgcagggagctaagatcatgcccagccaggccctgcctggactcctagcccaaagaaagcatgggaggtaataagatggttgttgaagccactatgtctggatgttatttgttccacagcaacgtcacataacggggacagggtggctggggtagagtgggttgaaatgtgtcccacctgctcccctaaaagaaaaaagagggagagagagagatgttcacctggaacctcggaaagtgaccttggttggaataagtgtcttcacagatgtaattaaaatgtggatcttgagatcagatctttctagtttaggggaggtcctaaattcagtgaccaatgttcttatgagacagaaaaggagaagacatagggagccatagagatgtgggaggcacgatgagtccatgggagcacagaggcagagactggagtgatgaggccacaagccaagaaacacctggagcccccagaagctggaggaggcaaggaagcatcctcctcttgagtcttcagagggaaagtagcctggctgacaccttaatttcagacttctggtccccagaatggtgagaatgaaatttctgttgttttaagccactacgttcatgacaatttgagttttttgggtttttttgttttttggtttttggtttttttttttttttttttttttttttggacaggatctcgctttgttgccccggctggggcgctatggcatgatctcggttcactacaacctctgcctcctaggttcaagcaattctcctgcctcagcctcccaagtagctgggattacaagtgcccaccaccacacccagctaatttttgtatttttagtagagacggggtttcaccatgttggccaggctggtctcaaactcttgacctcaggtgatccacctgcctcagcctccagaagttctgggattacaggcgtgagccaccacgcctcgctagttcatggtaatttgctgtggcagcccgggggaattagcacagggggctagaggttcccacgctgctgtcatcacagtgactgtattttacaactcctaagtcagatgcggaactgcaaaacaggatgctcctcagggaaataagaggacagcagctttgtaatcaggtgtcctgggataatggaagatgcctactggccacagctagagtgaggcccagagggccagaaggcttagggcaagaaataccggagaggctcgccatcaggatgcagtctgtctctcacagctccttacagaaaagctcaaatgaaacaaaaataagcaaaagtatgattgacccatgggggtcctcagtctcttcatcctagagtttagatcatctctctccaatacccacagtgcatctttttggcagagtgaaggtagccaaaaacccttcccccaaagatcttgtgtggatttgggattaaatccccacctggatagagttgggtgttttgttttgttttgttttagagatggaggtctccctttgctgaccaggctggcgtgcagtggcacgatgatagctcactgaaaccttgaattcctgagctcaagctatcctcctgcctaagcctcctgagtagctgggactgcaggtgtgcaccaccgcacctggctaatttttaaatttttttgtagagacaggatcttgccatcttgcccgggccattcgcaaactcatgggctcaagcgatcctcccacctctcccaaagtgttgggattacaggggtgagtgagccaccgcacccggcactgtggagttggtttaaccaaaatacaattctcaccataaatacatttttgacttaaagatatttccacctgtatggtggcattgcacccggcctcgacttagaatttttcaactttacaatgatgtgaaagcaatgtgcattcagtagaaatcgtacttcaagaacccataccaccgttctgtttttcactctcagtacagtactcagtaaattacatgagctattcaacacttaattataaaataggctttgtgttagatgagcccaactataggctgaagttaagtgtttggagcatgtttaaaggacgctaggctaagctatgatgattggtaggttaggtttaacaaatgcatttttttttgagagacagggtcactcaggctggagtgcggtggcacaatcatagcccactgtaaccttgaactcctgggctcaagcgatcccccgcctcagccttcagggtagctgggactacgagtgcgctccaccacacccagctaatttatttttaagtttgtatagagttggggtgtcatttttttttttgagctggagtctcactctctcacccaggctgcggcacaattgtgcgatctcagctcactgcaacctctgcctcctgggttcaagcagttctcctgcctcagcctcccgagtacttgggattacaggagcacaccaccacatctggctaacatttttctatttttggtagagagaggatttcatcatgttgaccaggctggtctcgaactcctggcctcaagtgatctgcccgcctcggcctcccaaagtgctgggattacaggcatgagccaccgtgcccggctaggtgtctctatcttgctcaggctggtctcaaaatcctgacctcaggtgatcctcctgccttggcctcccaaagtgctgggctataggcgtgagccaccataaatacatttttgacttaaagatattttcaacttatgatggctttattgggctgtaaccgctatgtgagtagaggagcatctgttcttcccctgaaactacaatcctgtatgtatcttaatgactggttgacatttctgtctccgtgattagatgagtgtctagggggcagaggtggtgactcagtttcccttgtaacttttgcctggcttgctggaagtattcattaagtatctgtagaaatgggcctgacacatcgggaagctacagtatgaagggccaaagggacttacctgagctcacctcgctcactggaggcagagctgggactagcaaccaattcccaatgcagtcttttcctggcatgcacgtccaagtgcctggtttggcggaggagtcagtgagcacccggaatgaggggctgggtggtgtttcttggaggggtgccaggactctgcctagaaacagagctttcagagaaatggtggcttctgaaacatagaggaagacacggggcatagagatgtttgggatagtcaggtgggaaagttctggagccaaatcggccttaggaggataaaacatccaaggaagaaatcaatggagacaaattctgtcggcagaatccagaatccactgaaagccatgaggaccctccagtgagagagggcatccacagcttggaaaaatggcctaggtatcaagggctttcgaagtgacttaaggagctgggtgtggtggctggtatgtgcctatggtcccagctactcaggaggctgaagcgggaggatcacctgagcccaggagttcaagtctgcagtgagctatgatcatgccattgcactccagcctgtgtgacaaagtgacaccctgtctcaaaaaaataaaaataaaggccgggcctgtaaacccaacactttgggaggccaaggcgggtgggtcatttgaagtcaggagtttgagaccagcccagccaacatggtgaaacctcgtttctactaaaaatacaaaaattagccaggtgtggtggcaggcgactgtaatcccatctactcaggaggctgaggcacgagaatcgcttgaactcaggaggcagaggttgcggtgggccaaggtcgcaccgctgcactccagccttggtgacagagtgagactctatctcaaaaaaataaaataaaataaaataaaataaaataaaaacaaataaataaatacacaaagtgacttaaaagaattgcccgcctatgctgctatctgctgatgatgtcattgacaaggcaggtcagtctaatcatcactctttcctcagcttccatgatcatgatttctcccagcacctcagtaatgaaggtgacactgactcatatgtacacagggcttttcacatcatgaagcctgggttgtcgtttaaattgtgcccctcaccgcccctgcccaaagatatctgaagttctaacctcctgaaactgtgaatggggaagttctaatcccctgaaactgtgaatgttaccttgtttggaaatagggtctttgcagataaaatcaagtgacaatgaggtcatagttgattagggtggacctaatcctataggactggaagtgaggagacacagaacatagggaggccatgtaacaacagaagcaagcaagcacggaggctcacgcctgtaatcccagcacttcgggaggctgaggcaagaggatcgctttagcccaggagttcgagagcagcctggacaacatggcaaaatctcatctctatgaaaaatacataaagcagctgggtgtggtggtatgtgcctatggtactagccactcggaaggctgaggcaggaggatcacttgaggcaggagcctgaggctgcagtgagctatgattacaccactgcactccagcctgagcaacagggcaagactctgtttccaaaaaaacaacaacagcaggccgggcacggtggctcacgcctataatcccagcactttgggaggctgaggcgggcagatcatgaggtcaggagatgaagaccatcctggctaacacggtgaaaccccgtctctactaaaaatacaaaaaattagctgggcatggtggcgagcgcctgtagtcccagctcctcgggaggctgaggcaggagaatggcgtgaacccgggaggcggagcttgcagtgagctgagatggcgccactgcactccagcctgggcgacagagtgagactccatctcaaaaaaacaaaacaaaacaaaacaaaaaaaacaacagcaacaacaacaaaaaagagactggggtgatgctactgcaagccaagaagtgccaacaattgcctgcggccaccacaagctggaagggacaaggaaggattcttcccgagagacttcagagggaacatggctttgctgacactttgattactggggtgagccaccatgcccggccaatagttgacttctgtgtttcctttttatttatttttttgaggcggagtcttgctctgtcgcccaggctggagtgcggtggtacaaacatggctcactgcagccttgacctcctaggttcaggtgactctcccaagtagctggaaccacaggcacatcatgcctggctaattttcctatttttagcagaggcagggtctcaccatgttgcccaggctagtcttgagctcctgagctgctgacaggtgtgagccaccgcacctagcaagttgacatcttgactacaacttcatgacaccttcatccagaaccctcacttaagccactccctcattcttgatccacagaaattgcatgttatcctacatgtttattgctttacaccactacactttgtggtagatagctaatacctttatcctatcccatcagagacagcatgcatagtggttaaaagtcaactattggccaggcgcggtggctcacgcctgtaatcagaggccaaggcaggtggatcacctgaggtcaggagttgacctgagaccagcctggctaacatggtgaaaccccatctctactaaaaatacaaaaaattagccaggtgtggtggcacgcgcctgtagtcccagctcctcgggaggctgaggcaggagaactgcttgaacccgggaggaggaggttgcagtgagctgagatcgccccattgcactacagcttgggcaacaagagcaaaactctgtctcaaaaaaaaaacaaagtcaactattggctggatacagtggctcatgtctgtaatctcagcactttgggagactgagaggcaggaggatcgctgaaggccaggagttcaagaccagcctgggcaacatggcaagaacctatctctataaaaaaaattaaaaataaaaaatttagccaggcatggcgtgcctgtggttccagctactcaggaggatctcctgagcccaggaggtcgaggctgcagtgagccatgtttgcaccactgagctccagcctgggtgacagagcaaaaccctgtctcaaatattggctgggcatggcagacaccagtaatcccagcactttgggttgctgaggcaggaggatcactggaagccaggagttcaagagcaggctgggcaatacagtgaaatcccatttctacaaaagaaaaatcaacatcacttactagctattgaccttgagtaagttgcttcagccttctctgagtctcctcttgtgaaaggataactgtatctgtcttataaaagtgccggaaggctgggtatggcagcttatccctgtaattccggcactttgggaggccgaggtgggtggatcgcttgaggcagggagttggagatcagcttggccaacatggcgaaaccctgtctctaataaaaatacaaaaattagccaggcctggtggctcacacctgtagtccagctacttgggaggctaaggcaagagaatcacttgaacccaggagacagaggttgagtgagccgctgcactccagcctgggcaacacagtgagactctatctcaaaaaaacaacaacaaaaagactgctgggaggaccaaaggagttaatatttaacttctaatggtccctgtggcatagtaaatgtgagtcattataatttgcatgggtgactaagaagctcaaaagaggcgaaaagacaactccagggcaacacagcccgtgactcattggtcaggctgagtcctgaacctgggtctcctggctccctgcacagtgctcatggttcaactgaaacctggaactagaatggccagtgaaatccgatgctctgtgtgactgtaacttctgttattccctcctgtgtggcaggctgtttcagcagccgtgcactgtctcccatccaagtactaatcaggcccaaccctgcttagcttcctagatgagacgagatcgggtgcgttcagggtggtatggctgtagacgcagccatgcactgtcaacagctggctatgcacctgtgctggggtggggagggcagccagttgggtcagactgtggctctgtgcctgaccctgagaagagagagcccttggtccctgcaggaggggtgttaggaaggtgcgctagggcaggcagacagcagactgcatagcgtctgagaggggcttttctggatcacatttcattgccagagcagctccaaggacagggaaggcaccgagctgctgcttgtagccctggttaggaaatggccaggagagcaggacaactgttttgaaaggcaatatgacattagggcaaaagggctgctgggaataaatccctgctgcacaggctgctttagtttaagccgaccaaaatgacctaggacaggccaggcgtgggtgctcatgcctgtaatcccagcactttgggaggccgatgtgggtggatcacctgaggtcaggagttcgagaccagcctggctagcatggcgaaaccccatctctactaaaaatatcaaaattagctgcccgtggtggcgggcacctggaattctagctacttgggaggctgaggcaggagaatcacttgaacctgggaggcggaggttgtagtgaactgagatcccaccactgcactccagcctgggcgacagagcgagacttcatctcaaaaaccaaaaaccccaaaatgacttatgacaagcggaggcccgggagccacagttcccctggaaggtctactcccttctttcttctaagtctgtggcttctgccccacatctgagaacaaaaagcagtgaatggccagagtgatgcaaagaaaaaagagcagaaacaagacaagctagtggcctgtgcaattcacctttgaatgggcaatattctctatgaaaattggatgcaaagaacctccaggtgtgcttgtagctttctaaagactcctcatggctaggttttccttaacggaaaacatcaaggaaggttactgagtgtggtttctctgaaattgccatcaggacctaaaataccccataacgaggagctccgatcctttcggctgatttactttttctccggagccttaccattttctagaaagaggaagttaggagtgatggggcaagaccagacaacagcagataatcattccatgataattgcctttgatgtcccggaagagacaacgtgcaaagagtcagctcccaaaatatcttgataagatcttgcctttggggttggctcattttctctgtgctctctgcccctccctccctagggcttcgctttgtgtgcagctaaccaaggcttctcacagcaagcctccccaccaaggattccatactcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactggggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaaggattccatgctctctgactctcactgcttctctccccatcaaacctcctttcccaggagttggtttaatcgtattgccatcctaccacacacaatccgatcacagctacggctcctcagcccccagactccactttaaccctcctgggaagcatttgcttgttttgaacatggatttgggccaggtgcggtggctcatgcctgtaatcccagcacttttgggaggccgaggtgggtggatcacctgaggtcgggagttcgagatcagcctgaccaacatggagaaaccccatgtctactaaaaatacaaaattagccgggcgtggtggcgcacgcccgtagtcccagctactcgggaggctgaggcaggagaatcgcttgaacccagggggcggaggttgcggtgagccgagatcacgctattgcactccagcctgggcaacaagagcaaaactccaactcaaaaaaaaaaaaaagaaagaaagaaagaaagaaaagaaaagaaaatggatttgtatttcattggctctcaaactttattagacgtaacagtcacctggagcactttgataaaataaaaattctgatagacaggtttgggtgagtgtcaagaacagtgcaaggttagagataaccaagcgcacgcgtgcttgtgtctttccacaatgtcaggcttttactgacgcatttcaatcacaaaagccatgagctacatggagttcccaaggaggcaattctccttagtacttcccgttcgcctgtacttagagccgcacatatgggtccatcaatactgcaaaccatacataataatacacttaagcaatatatacacgttatacattaaccattccacaacaaacaaagtagcatttaacatcgagaggagagagataggagaaagagttaacaaaccagtccagcaggagcaaagaagacaaaaggagtcctggtctgggccctgctcttcagtcctgcaaggaagagtctttgatgtggtagaggcttcgaaggcagagactgggttgttatcaggaggcagtgcaaggctgtgctaggaccactagaagaaggcctgctctttttttttccctgaaactgaggtttcactcttgttgcccaggctggagtgcaatggcacaatctcggctcactgcaacctccgcctcctgagttcaagcgattctcctgccttagcctcctgaggagccgggattacaggcatgcgccaccacacccagctagtttttgtattcttagtagagatggagtttctccatgttggtcagactggtctcgaactcctgacctcaggtgacccacccgcctcagcctcccaaactgctgggattacaagcgtgagccaccgcgcctggccgaaggcctgctcttttaatggttacagaatcctttggtgagaactgatcgtgagagtgtgcttctttgtccatccttatctggttggatgcagtctttgtttgttgatttattaagcaaaacttttctgggggtcaagggacagggtctcactctgttgcccaggctggagagcagtggtgcgatcttggttcattgtaacctctgcctactgggctaaagcgatcctcctgcatcagcctcctgagtagctgggactacaggtgcacgccaccacacccagctaatttttgtattttggtagagacggggttttgccatgttgcccaggctggtctcaaactcctgggctcaagcaatccatcctccaaggcctctcaaattgctggaagtacaggcatgagacacggcacctggccaagcaaaacatcttattctcgttgggaaagtactctatgaaatataaaatgaaatgtttttctaaggtggagttacttatattaagggtgttttatacagtgggtaatagtctttttaaaattcattcatttttcgtttttttgagacaaggtctcactttgtgacccaggctggagtgcagtggcaggatttcggctcattgcaaccttgacctcccgggctcaggcgatcctcctctctcggtctcccaagtggctggaaacacaggcatgcaccattatatccagcttatttttgtatttttttaagaaacggggtcttgctatgtcactgagtctgttctcaaactcctcggctcaagcaatcctcctgccttggcctcccaaagtgctgggattataggcatgagccaccacactgggccaggttatggtcttaataaagcttacaggagattgcgaagaaggtgaatctagaactcccaggaaccatgttttcatagggatgacttcagacaggcatgggaagtattttgggaagggggaaagagggcacaagaaaggaggcgatgcctaatcctttaattatcttttcaatagtggtaaggcaaaaaacagggaagaatagagaaaaagaaatgtaaggctctcgttttcttttcttttctttctttctttcttttttttttttttttttgagatggagtcccactcactcacccaggctggagtgtagtggcatgatcttggctcactgccacctctgcctgctggattcaagcgattctcctgcctcagcctcctgagtagctgggattacagttgcctgccactacgcccagctaatttttgtatttttagtagagatggggtttcaccatgttcaccaggctggtcttgaactcctggcctcaagcaatccacctgcctcagcctcccaaagttctggtattacaaacgtgagccaccacgcctggccaaggctcgaattttcttttttttgagatggagtttcgctccgttgcccaggctgcagtgcaatggtgcgacctcagcgtaccacaacctccacctcccaggttcaagcaattctcctgcctcagcctcctgagtagctgggattacaggcatgtgccaccatacccgcctaatttgtatttttagcagagatggggtttctccatgttggtcaggctggtctctaactcctgacctcaggtgattcaccctccttggcctcccaaagtgctgggattacaggcgtgagccaccacacccggccaaggctctaattttctagaaggtttcattgtggacccctctgtgccacctcaccttggccctaccctacgctgatccctgtttctccaagaagcagccaacctgaatccttcatggggcatccacactgtttgtattgtggctgtttctcctttcattcctcatagttaacatccacaattcttaaacttgcctccctggttcccaaggccagtgtgcatcactgcattagtccgttttcatgctgctgataaagacatatccgagactgggcaatttacaaaagaaagaagtttaatggacttagagttccacacggctggggagacctcacaatcatggtggaaggcaaggaggagcaagtcacaccttacatggatgggagcaggcaaagagagagagcttgtgcagggaaactctgacttataaagccatcagatctcatgagacttactcactatcatgagaacagcacaggaaaaacctgcccctatgattcaattacctccctccagttccctccagcaacacctgggaattcaagatgagatttgggtagggacacagccaaaccatatcaatcactaaccacatttgggtgatgtggatgtgaaacaggcttggaggctcgtcggctagagattccgattcaacagttcagaaaggggcccaggaatccgctttctaaacaaacaatgtaactggttctgaagctgtgcactgatgctggaggaagtcgaggggccggcttcatcaccgtttttgccagctgctttccccacgacagaattgcggaacagaggatgatgagcctggagctagcagcacccaatcactaaggtccgctaccagaggctctgggatctgtggtttcatttaagctccacagcaagccccagaggcaggggtcattgccccgcctttgttgttgttgttgttgttgttgttgttgttttgagacagagtcttgctctgttgcccagactggagtgcaatggcacaatctctgctcactgcaacctccgactcccaggttcaagccattcttctacctcagcctccggagtagctaggattacaggcacccaccaccaggcccagctaattttttgtatttttagtagtgacagggtttcaccatgttggtcaggctggtcttgaactcctgacctcaagcaatccacccgcctcagcctcccaaggtactgggattacaggcgtgagccactgtgccctgcccattgccccattttatagataggcaagttctgtgctctttgggctcctctactgcccctctagctctaaaactgtgattccatgtggggaagtcaaaacccaggcttaagcccgggcacagtggctcacacctgtaatcccagcactttgggaggcagaggcgggtggatcacctgaggtcaggagttcgagactagcctggccaatatggtgaaaccccatctctactaaaaatacaaaaattagctgggcgtgatggcgggcacctgtaattccagctactcgggaggctgaggcaggagaatcgcttgagcccaggaggcggaggctgcagtgagctgagatggcaccactgcactccagcctgggcaacaaagcaagactccgtctcaaaacaaacaaacaaacaagcaaacaaacaaaaacccaggcttaagctttatgcccgtcaccacgtgaccttggtaggctcctctcaccctggcctccagcttccccgtaaggataacgaagtcagccccatcgtctggggggtgcagcttctcagaggccaaccctggggcgctttgctttgttggaagttgagtttgattacagctctaatcatttgtcccccaaagtcaactttcttttattgcttacactgcagaatcatccagtctcaattaaaaaaagagatcccacatagtccagtggttaaaaaaaaaaccaaatttttttaataggaaaatagaccctcagaggaaattggtcactgggtttaactgggagggattgtctcgtgcctgtgaatgggttaatgtatcagggtgggcatgaggacaaattataaaaccaaaggaaaatgccgaaaggccatgtgagtgacagcaagaatgaaggctattgcatccgaggcctgaagtatagacccaggtcccactttagcataaccacggctgctattaagaccctcaaacgcaccatcagtggttctgaattttgcataatgattgaactctgccgtatcatcagaggggaggagaacggcgtggaaaccaaagggctgaaatctcagcccctgccaagccttctggggctccatcacactcccagaatagcgcggctaggttcccggcagcctcgggctgcgccgcagctgggcttccggagagcgagacgagtcaagcctcaagcactgccggggacagctgggactggacaccacccagaagccagctggctggccctgccctgccctgctggaggcaccatctctggtgagtgggggcatgtctgactcccctgcggctctcccaccattacctggggccccagctgagtcaggggtggcctcaaatcccaggcaagagggtggcatcagtgagtgggtctcctgaagtctttggtggcagtggctggagaaggtgttaaagggctgaatggccctgcaggtaggggaggctgcagtgtgtgccaggcggatgtgactttaggaggccagtggccaccagcagaatagggatgggaaatgaagatgggcgggcagggagacacagccctgccacaggccaggcaattgccccgtgcagtgcggtcttgaagctggcgtctgaaggtgaagggattgttggaagaagggagggtggccaagcccgtttccagcttgacaacagttatgtgttttccagtatcctccttcattcatttattcccttacaagtattaattgaggcagggccccaggggaaacacaaagatgggtcaggcacacatcttcccttcccaagagcttataccttggctggggacataaagcatgacagaaataaccatcgataaggcagaaaatgtcagggctatataagagataagagaagtgtactggggagcacggtacagtgaggtgcaagtccagcaggctaaaggaagatagttctaatctacagctagccactgagtctctatgaacctcagtctttaaatatataagatggagacaataacatctgccttatggaggcttatagggttgtaagcatcaaatatatataaaaggtgcttgaaattgtacagcaatatacagaggtaagctattatgggtatcgtattatccaactagccagcatctctctgaacttctccgcctggaattctgggagccacagggagcccaggatctgagtactgggttcttgtcagcagcaaagcaaagtctagaccctgaggcctcctttccccttatagaaggctgacagcctctctcagctcttggccaatcaatccaattgatccacagatatgtagtgcccattttttggatgtataaagcactgtgctagggaccatgggcgtggagaggcatgaaatccagagtccattccctacagacctatcatgagccagggaggcaagatctctgtttataagatacacctggccgggcacggtggctcatgcctataatcccagcactttgggaggccaacatgggcggatcagcagaggtgaggagtttgagacgagcctggccaacatagtgaaaccctgtctctactaaaaatacaaaaaaaaaaaaactagctgggtgtggtggtgggcgcctgtaatcccagttacttgggaggctgaggcaggagaatcgcttgaacccaggaggcagaggttgcagtgagccaagattgcaccactgtgctccagcctgggcaacagagtaagaatccgtctcaaaaaaaaacgaaaaagatacatctaaggcagagccatgtaagagtagcaaatgcatgccagaggtgggatcccaggagagcagagggaggaagaggactacagggtggggggtaccagcaaaagcctctgggaggagccaagggctttaaagggggatggaatcaagaggtcgagaggaggagagaggcatcctggattgagaatacgggacatgtgagcgaactcacaggaaggcaagtgcgggggcgaggcagactcagagcaggcttctcaggctggagtgaccatttcctgtgggggaacaggaaggagaagaggctggagtcaaggctaggtacaggttgcagaggccttgaatgccaggcaagggagcctggactttcacataaaggcaccaggagccagtgaaggtgttaggaatgaaaggtgttggggtgaagtcagtgaaggtcctgccccggatgggggtttgcagggtgactggagaagactgccaccaggggccatcactctgggggctggtgtagccactgcagcaaggtagaaggaatgctccccccgaaatgctcacagattggggtgagacgcttcctgaaggtaggggaacaaattgcagtgagggctacacgtttccattttgattttgatagaggcaggctgactgagtggcctggatccctggacccttggccttgatgtctggttctcaggatttgcgcagtctgtggatggaggctgaccagatcagagcagctcaggggaccccgttctctccttccacagggagttggttagcggccactgagccctgggcagggagggggatgagggaggagcagattttgcagccatgggggagggttcagcatcaggtgacattccagtggactctgcccaaggcctgcttccgggtacacttccagagcgatcacccatgggcagccagttgtggtgaatgagggtttcactcgcctgctccctggccctggcttcctccttcttaaggggccacgatgggacccgagtcctttcaaaaaactaggcagttcccgctgctccaagcagaaagtcctatgagcctaagagaaaaagagatttggccagacactgcagccagggcaggaaccagttaatatgagcctgggagcaaggagaggtgaaatgctgtttaccagcagccggctgtgggttgcagggcacccagccacctagcacaggattccaggccccaacttgtcaggaagcaggagccccaccctcagctcagtgagggactattcctccccatctggggcctggctgcaagacctagggctctccactccccaggtagagggagcaggccttctactctgtggaggaggaaatggctcctgttggagattctgcagggtgagactgcaatccagaactcctgctgcccaggcaaactgggaagtccctctaaacaacacaactgacctctggctctccctgggtaggcctctccatgcccaaagccggggtgccagggcctcctgccctcatctctgatgcagggcattgcagccccatggcaggtgacttctccagtaggcactggggcttgcctgcttctcagaaagtggggtacgggaggcagggcaggggtggtgctgtttgcaaggctgctggtgtgagggggaagatcggccgtggccagccacagaataacggatattccacaagcatttactgaaaacatttacccacacccgtctgagtgccagatgccagggaaaacaagatgagtgagacatgtccctggctctctagaagggcacagtgtaattggagaaaaaacaatttagaaggctaattatgatacactaggataaatgataaataaatgaatgtgtaacaggctgtgggtaaatagggcaactcacaatgggtctttcgtgggaaggtgaggatcgcttcacagaggaaggaacattggagctgagctttggggcagggcagattttttaaaactttttggtcacaaagaaaaaggatggtaagaggcataaaatgttcgaggtggaaggaacatcacacagagcatggcatggcaaagctattccaatcatggtgaaacagaactgaaagaatgccagcttctgcaagagtttgggttaaaaaccattaggccaagcacggtggctcatgcctgtaatcccagcactttgggaggacaaggagggaggattgcttgagcctaggagttccagaccagcctgggcaacatagtgagaccccatctctacaaaaaaatgcaaaaattagccatgcatgatgatgcactcctatagtcccagctactcgagaggctgaggcaggagggttgcttgagcctgggaagttgaggctgcactgagccgagatcgcagcaccgcactccagctggggtgacagagtgagatcctgtttcaaaaataattgattaatttaaatttaaattataaataaaaactgtcagacctgtcaaggcttagagggaatgacaatcatgccaggaaaggggaggctgatcgctggctccctgtaagcaccaggcttgtgtgaggaacattccagacacagcttcattctgggggtgatgttatcatccagttttacagttgaggaaagcagggctcagagagatgaagcaactcatccaagtcacacagccggcaggtggcacaggtgttcccacctttgggccttgtcaagacctcagacatctctgaaggaggctttccaacgaacaaagggtttctcactctgccagtaggaatccaactcaggtgggggtggaggtagttgggtggtggacacagacatgcttctccgcaatccagaatctttttttttcctttttatttcatatattaaaaaaaataaaataaataggctgagcgcagtggttcatacctggaatcccagcactttgggaggccgaggcggaaagatcgctggagctcaagagttcaagaccagccagagcaacacagtgagaccccatatctattttctttttcgtttgtttcaatagagatgaagtctatgttgcccaggctggtctccaactcctgggctcatgcgatcctcccacctaggactcccaaaatgctgggattataggcgtgagtcactgtgctgggcctcaagatctctttgaacagtagcactctttgaacacttctcagagtgtagttttttggtgaaaacagagtttgcaatgggttctacgcctactggggtattaaatcaaagtgaaggacatttgggggcacagaggaccctgtggctggagtctcggaaagcagcgccacctcccacagaacttcccttccagcatcacaggctcgctgggtccagcagcccccaccagggtctgactcatggtggaggggtctcatgccttctccaactcttgcctccccactctggaccagcacaggcccccgggactagagcagagaccaacagggaccctgaaggctgaagcccatgtcatcggccccaaaggacttgctttgtcctttaaaggcaaatcctgcccaggaagtgagacggagtgaacacaaaaagagcaaacagctctcaggaaacctccctacatatccgccgccatctaccatgcagggctggcagtgggcagggctccgctgctccgtccaggcctcagatgccccagcctttcccccgcctgggtcgggagggagtggtaaagagttgcctttttggagaatctaggtagggaaaagagattcccaaagcttgaaaataaattgaaacagatctgccagatccacaattcatctttggcttcttaaggtcacaagcagtctcggggactatttccattccaccttcctctagctcttagctggcttttcacatatgctaatgagcggcccctcccagcacactgtgttcagcaccagttgcctgcttcacgagaactagtcccagcccacagtcacggatgcccctcgcctaggtctgacccgccgtttgcctttctagcgttggcactcaactgcttggaccctacaagcgtttgcctccctggcatgggggcctctgaatcttagggtgggaggtggagctacggaagggagcccaggagtgagcaacagatcagcagcagcactgcgcccctcttcttaatattgaagagacttgaaacaattcagtcttcgccaccccagaccagcccgtgagggcaaggccaggaagggatacagggttctagagaaccagggcctcaccgccagctccggccgctaagcaaacattccctccaggagtccgagaagccggtgtgcgaggggaggaaccagcctgaggtttatcgctccagcaactccgggtgattcatagagtttagactcccggttgtcgtagaccgcggcaggcacgcaaacaagcagcccgggagataccctcccctttcccagcccccgctcctccaccttgctaccccctagcccgtgaccagctgcctcccctccccctcgcgggcgctcagggttgagcaaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgccttcccgctccgccgcccggaagagtcgggtcgggacggcggggagtgggcgagggcagaggcggggggactggacatcctgcgggctggggacgccgcgccaactccgctcggtcgctgaaagttttcaaacccgagccggctggggactgggggggtgggggagcccggcgctgcggctcgggctggagggaggggaaaccactccataatcggggtctccaagaggagcccctccaccgcctgcctctcggtgggagtccgcggtcactctctctcgtgggtggcgtcctctctgccgcctgctactgtggatgtggagggcaggtttctgtggccctaaaaatgggagagagtgactggttcccttgctccccattccagccacccagggagcgcaggtgtagaccccagtaccgtcgacccaagtagggacgagagggttcagaatccccctgagggaagtttggaaattcagactatcaaagcgcctccccttctggtagcctggcccctagatcccgaacccccactcccggctggcttttccagcgtcctttgcacctccatccccaggcccgcagtgttacacgctggaagacccaatcacttacaaactccacgatcaagatcctaaagcccgggagaggagactgttggaagtagggttttgtgctcctggagcttcctctccccgccggccccccacccctgtgccttcaactggactgggggagggagtgcattggggggtggggcgcattccagagtgacattccagagcagacccttgaagatttccaagtctcagagagctcagggcattttggcccaaatgcctggtcttggtgcggggcaggggcagggggataggggtggggtgtctaggctgaggttcgaggaaccccaacccaccccccaccaacctacacactgaggccgctccttccaggcacaggcgtctcctgtgcgccttcttatcgatggggtaaacgcctgagcgccctgcacagaggggtgagacagtgggacctaaccagggactgggagagaccgataggagtggaggcaggaaggctgtcagtcgggccatcgtctttccctataggctcttgagtgtgtgggatgggaggaaggcaagtgctctgtggtatccctgggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaatcccagcactttgagaggctgaggtaggtggatcaccttaggtcaggagtttgagaccagcctggccaacatagtgaaaccctgtctctactaaaaatacaaaaattagttgggcatggtggtgggcacctgtaatcccagctactcgggaggctgaggcaggagaattgcttgaacctgggagttggaggttgcagtgagccgagatcatgccattgcactccagtctgggcaacaagagtgaagcttcgtctcaagaaaaaaaaaaaggctgggcgcagtggctcacgcctgtaatcccagcactttgggaggccgaagcgggcggatcacgaggtcaggagattgagaccatcctagctaacacggtgaaaccccgtctctactaaaaatagaaaaaattagccgggcgtggtggcgggcgcctgtagtcccagctactcgggaggctgaggcaggagaatggcatgaacctgggaggcggagcttgcagtgagccgagatcacgccactgcgctccagcctgggcgacagagcgagactccgtctcaaaaaaagaaaaaaaaaaggcattggctgaatgtgcactcccggcatcagagggctggagctgtgctcttctgagcttctctttaactctctgagggtccctgtcctaggcagtggatgagagccacgcccagaaagcccaggtttcccacctgagtccatgtatttctgtcttcccacctgcccttccatttctgggggaaccagagaaataagatatttcaggatgggaccaggttgtttcctctgaggctgttaagttactcagcaacttactaaaagcagcagcctggctgctgggcagcagcatggtacctggatgcggtgaggggcaggtacaggctcctctctcattccttgaaagtttctatattgagggggttggcaggagaagcaagacttgaagggtcaggtgcagaaggaagttgctggtcaccaaccacaaaatcagggggaaactggaggtgggggcttagggacagagagctgtgaagctttcctgaccctagcccaagtgcctgtgggcttcttggagccagcagggtacaggcaagtatttctagggcaagatggatcaagaagaatgagtgacattggtccctggcttggttttctgtaatgacatgcctgttagatttgaacttgtagtatgggctttagtatccttttcccccacctccgccatccaaccagtccttcgattgttttttggaaaggatctttcagagctggccattatggctttacctttggccttgacctttaaactggaatgaatgtgccccccaacaaatcgattgcctgtgcatttttgccagactcttttcctaaaagcgcaaccctggctatgcccccatgatgctaaaagcagccttcagtggctgcctgttgcctttaggataatgcccccagccccacccctgtagcatttccaatgtgtcagccagcagctgcagcctccctttgcagactcagctgatacttggcaaactgaattcttttttaacttgctctggacttgggctcaaagggctttgattcacaccatcttttctgccttgcacgtccctctccttgttcccttcacctgctcagtccttcctcacattcttcagggcttagcttttgggtgtccctgtctcttggcagtgtctgggacctggtatgtttttttattagattctgagtaaaactctgcggaacagtctttctctactctgcctgtttctcttctgtgttcctgtagcccctgtctctctcctgcaggtaaattccgttgtgtggcccttaatcatattcttccttgtgtaatttttgtgagtacctaccttatctctcttgatagattttaaatgccatcaagtcagggactacgtttgttcatgtttgtattttccacagctctgggaacaacagggcctttccttcccaggcgcacagtcaatatttgctgatttggagtaattgcctgttctaaactgggccctggccgagggaggtggggtgaaaagcccttgaaagtgcaggtgtccggagtctaagtggcagttctgagggttctcttccctacgtccagcttcaagcccaagttctggctggtttggctgtggagcccaagatgaagttgaacatttaggatcccacagcttgttgttatccataaattatctcccaggagtgggtccatattacgccttcccttttttgttgttgttgttgttgtcgttgttgtttttggtttttgagatggagtctcgctccgtcacccaggctggagtgcagtggcgcaatctcggctcactgcaatcttctgcctcccaggttcaagggattcttctgcctcagcctcctgagtagctgggattacaggcgcacgccaccacacctggctaatttttgtatttttagtagagacgtggtttcagcatgttggtcaggctggtctggaactcctgacctcgtgatctgcccgccaaaagtgctgggattacagcatgagccaccgcacccagcctactccttacctcttagccctctcttactcctctttccagcacttgtaaataaaatgcagttggtgctttattgatttacaaagtcccctacagaagcttatttaagtcctgcattagaagtaaagagaaactagccattagaacgccagttatttaggaaaacaacagtacatttacatgagatagttaattttaagagttaatcttaagcaagcttaattgaaagatgaggtagctgagatggctaagacgacctaaatattttcaagtggcatggagactatttgaagggactttgaaaatggatcctctttattgtgtccatttcacttaattttatgagttgcattgcccctgatttagtaagtgttctttcacataacaattatggacagaatttttttttttttttgcttctgtgttgaaaagagggacaatttctatcaactgtgggatttagggcttttgtttgcctattagaaattaagtagccaggaatggtagaaaacagtaaggaggtaaaccatgtataaacaacctcacaatccccctaaaaaaggaaaaagggtggcagcctcacagaagagagttagataatgccattcccctgccagccactagtggtcactgtcagaccaggaaagcttggttgctgttttcccagagagttcctgatgaagctgggttacaactagttatttgaacacgtggggtgacttaaatgtggactacctgcattcatagaattttgaaacgtataacctgtttctttaagcatttaaattttctttttcttttcttttcttttctttcttttttttggaaacagtctcgctctgttgcccaggctgcagtgcagtggtgcaatcgcagctcactgcagcctcgatcccctgggctcagatgatcctctaacctcagcctcccaagtagctcagactacaggtgcatgccaccacactctctgctaattcatatatatatatatatatatatatatatatatatatatatatatatttgttgttgttgttgttgtttgttttcatacagagtctcactctattgatcaggttggagtgcagtggcgcagtcttggctcactgcaacttccacctcccgggctcaagcaattctcctgcctcagcctcctgaatagctggtattataggcgtgcacctccacgcccggctaatttttgtatttttagtagagacggggtttcaccattttggccgggctggtctcgaactcctgacctcaagtgatccaccagtcttggcctcccaaagtgctgggattacaggcgtgagccactgcacccagctgctaatttttgtgttttttatagagacggggtttcaccatgttgcccaggctggtctcaaactcctggactctagcaatctgttcaccttgacctcccaaagtgctgggattataggcatgaaccaccgtgcccagcagcatttaaattttcagtgttaggtttcctccaagtacatttaaaacttttgattggaaaaaaactcattgatttggtctttaatatttcttaacctgttaaatccattacctccacttcacgtgggaaaatccaattggtattgggagcaggagtttggttttcttctctggcacagatctgtggcatttggtagagcggcagtcagtagatggagtgaaaattaccttgctggtgttaataaaagctaattttcttgccttctagctacaacgtcttaaagtcttctattaaagattaattcctttgggttttgcattgcccttgcctggttcttacttttaaaatgttaatgctccgaaggaaaatttttgcattaagtcattaactccttagctggggacttcgtttatttcacccttgacttccgcttccgagctaggcaaaaaatggaggattctgaactggagacttggcactaaaagtgggaaaatgactgtctcttcatttttcctggctgttggttatgcctgctgcagctgcttgttaagtctattgaatgaatgaatgaacacatagctgactggctgtggatttaggcctcacaggaatggagtttaggggcatagcagctgacctcctgaagcctgaaagtcccagggcagagaggaggtactgggtgggtggtatgcttggtcttgacttgttcacaagccccttcatcctccaccgtggccgccagagctcagggaatatctgaacccaggttatgtttggtggaagggagggaactgaaaattcaatgacaggtttttcttttgccatggctaggaatagggctgacaaatgggcttcatctcatttgcctctgtggccagttgaaatgcctctcaggggttctatgttaagaaggattctgaggtccagagagcctcacggtcagcagctagcactatctgcctgggtttaggttgggggaagcagcaccatgtatattggagtctgatcttggaggactaattttgtcccttttccttctgtctctagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcaggtgggtctctgtggatgcccccagtggcccctttctccatcccatgtcttttactgcaggacagggagccagtctcttgagcaaaatggaaagtttttgaggttttctgtagttttctgcctaagtgtctctaaattccatttaatttaaagatttttttttttcagttgggcatggtagatcatgcctgtaatcctagcactttgggaggccaaggcgggtggatcacttgagacgaggagttcgagaccagcctgatccacatggtgaaaccccgtctctactagaaatccaaaaaaattagctgggtgtgctggctcatgcctgtgatctcagctactcgggaggctgaggcgggagaatcacttgaacctgggaggcggaggttgcagtgagccaaaatcgagccactacactccagcctgggtgacagagcaagactccatctcaaaataaataaataaataagattttttttctatattcatataattcatgcatacattctcactgtaaaatttcaaacattacagataaaatgaaattttccccagctgcctccccagtcctacccgtcccatcctgttccatccccagaagtgaccactattgactgatataatatctatgtgcctttgtttctccatttgtaaaatggggataatgtcagtacctatttcatagggttcttgtgaggattgaattaattagtgccggctgggcgccatggctcacacctgtaatcccagcactttgggaggctgaggtgagtggagcttgagcctaggagtttgagaccggcctggacaacatagtgaggccccgtctctacaaataatttcaaaaattagccaggtgtggtagtgcatgcctatggtcccagctcctcaggaggctgaggcaggaggattgcctgagcccaggaggttgaggcttcagtgagccgtgattgcaccaccacattccagcctggatgatctcaaaaaaaaaaaaaattacttagtgcccggcccatgaaaagcactcttgaagaattagctatttgctgtgtgtgcgtgtctattattttacatattttactaatactatccttccagaacttgtttttctattatgtatgtatccataatcaccttagttttctttaaaaggaagtatttttcaggtaatttttttctctttttttattttttgagacggagtctcgctctgtcacccaggctggagtacagtggtgtgatcttggctcactgcaacctccgcctcccgggctcaagagattctcctgcctcagcctcccaagtagctgggattacaggcacgtgccaccacacctggctaatttttgtatttttaatagagacgggatttcactatgttggccaggctggtctcgaactgctaacctcaagtgatccgcctgcctcggcatcccaaagtgctgggattacaggtgtgagccactgcacctggcctttttctctttttaataaaagtatttggggtgccgtgtagtggtctcagcagcgcccttgttagctgtacagcccactagcatttcctcagcacctgctctgtgccagcccctgtgctaatccccttaccgatgtggcccattgcacgcatcccacctgctcttcctcagcctgctggctgcagcccctcatctgacatgacctggaaatttgggggtgccatctcaaagtcctgaccctgcccccagactgtgctgatctggaggcctgggggcttcagactttcttaactgcccggttaacaagcaccggctctggggtctctgctgggaggtcagagtcaggcagtggaagttccagaatcagagacattcctttctcttctacacactgtgaaatcctcataatccctgctttggagaaagagatgacccttgtcctgccgggcacttgatctttgatctgcccacctgggctgaggtgctggcctcacccctgggtggcccctgtcacacgcacggtgtgcatggcgggggtggaattggcaaaacccaccagagaggtggggcttacagacaagtgctgggaggagcctcaggccccgcccccacactgaatgccggtcggggccaaatggttctcaaccttggggctgagtttttacttcctttttttttttctaaatggaaaaatcaatagagtgagcccagccccagcacttaggaaactctatataggttgcggtccctcagaactgcagggccgtcagccttgccggagccagacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccggtaagtgggttccccaggtccccgtgacacgtctgggctacagagaccagcctcagcaggccagtgggagaaggccatgtggccagagctgggttgggtggaggtggtaaggggaaggcaagcttctccatctggtgcttttacctggggaatccagagccccagttcttaaattccttgtcctggagtcagtgtacccaccaccttcagctgcactgcagtgggacccgccctgtgtcactggggcattgcacacaggttgtgtcgggatgctatagggaatgctgggtgagctctccctggtgggagctgccagctttaccctggagggcttggggagggacaaaggagggtctcagccaggtgctcccaaaatagacaggggtccaaatgtcacaggtctggataggtgtttacttctcaaccacagctgtgccaagggggcccacactctcctccctctctggcaggcagcaagtctcgaccttacacctccccctgggttctggaaactagaagcatcgttagccaggggagggggagggagcaggaagacggtgggttggattctactcactcctatatgtgttcctcctcccggctggcagaggctgtggggagaggtcagtgacccgtcttggcaggacactgggaacaggaaacaaggaggtcagctgggtggcgttctcatccccctccccgccctctctgtgagagccgcggggcagggggaggtgagtgtggctgaagcttccaatcccagcgcctcccctctccctgagcctgaacctgagcctgggcagaggagagcttccggagcaccaggagtggaggctgcgggctgtcagctctggcggggagtgggcagccacagaagcctttgctgaatagcttccttcactgttgctgcacctcactccccagcgcgtttggagtctgcttcctgggggatgatctggattaacagggatattttatctgaccggttctcaaaacatggtacccggaccaccagcactagcctcacctgggagcctgctcaaagtgcaaatgggggccaggcacaatggctcacacctgtaatcccagtactttgagaggctgaggcaggtggatcacctgaggtcaggagtttgagaccagcctggccaacatgctgaaacctcatctctactaaaaacacaaaaatcagccaggcatagtggcacatgcctgtagtcccagctactaggaaggccttagccagaggatcccttgaacccgggaggtggaggttgcagtgagcacagactgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaactcttgctctgggattgtggtttctgacctggcctcctggtttctgatgaacgtctcctccaccatggcctgtgggtgacttctctttcttccctccaaatccagctcacatttaaagctgctgcagatttttcctgtgcagttaagtagctgatgcctctccccagtgagtggttctttagcaggtcctctgtctgtattgtgtgcgatcagaatgaacacccaggctcagtgcgtgcctaggatgcagtcccgcacctgggcttgtctgaggccaggcagctttcctctgggaacccccctccagtggctgtggggataggactgggaaggtgagccttgagccaggtggctctgtgtgtaagggaagatgaactcatttcagcttctcctgggatgaatgacagtgaagatcccatagcggacaaagtggagactcattctgctccatgctttgagatcacaccgtgtgatacgtgcaaaggaatggcctagagagggtcaggaattgtttacaaatgggttgacaaaagtgcaaagggttgggccaggtcctggttggtttcgttcccgagcggtcattaaaatgtccatttatgcggggtgcgatggctcatgcctgtaattccagcactttgggaggccaaggtgggaggattgcttgagcccaggagttccagactagcctgggtaacatagtgagaccttgtttctacaaaaaaaaaatttttttttaattagccagacattagtcctagctactcaagggggtgaggtgggaggatctcttaagcccaggaggtcgaggctgcagtgagctttgattgcaccattacactactgcctgggcaacagagcgagactctgtctcaaaaaaagaaagtcagtttgttcggtacttatactaagcaaaagcctttcctcagcagctcattttttaatttaatttaatttaattttttttttgagacagagtcttggtctgttgcccaggctagggtgcagtggcacaatctcggctcactgcaacctccgcctcccaggttcaagcaattctcctgcctcagcctcttgagtagctgggattatagacatgtgccaccacacctggctaactttttgtatttttagtagagacagggtttcaccatgttgcccagactggtcttgaactcctggcctcaagtgatctgcccacctcagcctcctggagtactagggttacaggcatgatccaccactctcggcccatcagctcattttaatccccaaggctgccctggaaggtgggaaggactagtattctatcccttttccagattcaaaatcccagaactgtaccattttggggtgagacagggcctcagagtagttctaccgcccccttttacaggtaagcgaactgacccagagaggccaggccaacaccaaccaggttttcctaagactctgacgtccagcagcctctctccgtggcccaccctgggtaagccagtccagtgggtggcacttccagccatgtggttgagacagcagggtcctgacctttggacgctggctcaagactttgccagggggctgccaggccggccccggggagcctgctcctcccaggcttgggaatgtttctccccagctagtcagaagctattttctgataccggttgtaggggaaaaaatgtttttgttgaaagggagagaaaggttgctgggaaaaaaaaaataaacttgaaggggagagaaagtttgctgggaagaaaaaataaacttctcccaaaattctccttctatgctcagattgcattagcctcctggggactgaaacactatttttaagtaaaaaccagttcttgggccccacgcagtagagtcccctttgactcttgttctttctggtcactttaggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctgatgggcagatgtgttgtttctacctcatcttgggcagcacctggatatgctggcgctggttcatcactggaggagcctcttgtattttgagccctcggacatgctccagagggtcctgacggtcacccagcaaagagggggtacctccatggtgctggcaccaaagacagagatgggcacagctccaggctcgtgaaaatgagctctctataacattgtcttcctgaggtttttcctgcccttatccaaggtgggccctaaagctcagtccccagcccagcagcacctctgggtgccggggtggaggatgacgaccagagcagctctctggagaggtgccctgtagtcagtcccacagctctctggtgctacccccgtccccagcagcctgtgcctttgtcactggcatacttttccagagctaaattgggcgagcaatccctgcagagtaggattgcagctctgactgtggcccccgacctctctgtgttgcctgtcgaagtccatgaacagaatgttatttccctccagtggaagggaagcagggagctctgtggacctcacgctgcccttggtctagcttagcggccccaagatcccttagtgaatcaaggcgctgtgttgctttcctatgtgataatttcaaaggagtccccggcagggcctgatacccagaggctgcagtctccagtggacgtgggtgtgtgtatagcctgagtcctctgggggtctgcgcgtgaggctcagggagggatgggatcctaaaagatgcaggcctgcctgtattcaggagtacccactggccctgcttactcccgcccgggccaagtggagaagaagttagatgagttcttaggaggagagaggcagcttctttgaggtggtcgagtggcatcacaaacaagcgttgaatggaaaaagactagaagaggcagagcctgtcacaggttcaccatcatccagccaacactatgggaaatctcacacccaccactgtcaaaccgaggactttggacttaataactgctcagaattaaacgaccttaccttccatgggtgagggcttactgccattgaattcctgtgtgttcataaattctgggagttactagttttttttttttttttttaattatttttagagacagggtcttgctacgttgcccaggctggtctcgaactcctggcctcaagcgattctctcatctcagccttccatgtagctgggattccaggtgcctgctcccccacccccgaccctgcctctgggatttttttcatgtgtatttccctgctagacctcttgctttttacaccaacaaatgctgtttgattccaactaacctttttctctgttggggatttattttaaggggaaaaccaggcctccaaaaaccactgagctctcaacccgtcaaggccagagaactctaacacctacacaagatgtgggtggggagggaggcgaccccaaaagtatccctgttgctgcctggcatggctggaagaggcagccaggatacccattgggtgaaattctcagtgcacagaaccagggatggctggtaaatcccctgggccatgaagacctgcctgccgagtgcctttcctggctttccagtttactcatggccctgcacttgttcgtcagccccccacagctcatagaagagagcaagcaacagaggctaagtgcctgccctgtgggggtgctgcttggaagggtctgttggccctccaagccattctcgccaagggcagcattttcactagcccccggaggatgcgccaaggtcaggcacaggtgccaggaaccaggatttgtttcctgtctgccgtctccactctgggccctccaggaagctgcagcccctgttcacagcagctgcatgaattatttagcatctgcaccagaccgggagtgctctgacctcatcctccttgggctcagggtgcggttctgacctcatcctccttgaaaaaaggttgttgataggcagaggctggagcggtgcgtccctctggggtgcgggtgattaaaagggagacaccagtaccctcagagaaggaggtggggagcagcgacccatgcccttgtcgcaggaggcaattctgcagcacgcagaaaatatgactttggaatcagaggctgcgggttcacatcctggctgttagtagttctgtgaccttcagcagctcccttggtccttcctcagtcttctcatctgaaaaatgggggtaccagccccctgagtttgtgtttggtgttctgtcccctccagataacccccacgaaagtcacagtcaaggcagagcgtccaggcaccatctgcccagtgtttcctgcccagacaagcaggtcttctggccagatttcagtttggcacctcctggtgccacatcttcccttccctctatgctgcctcatgccctgggtccccagagtgggtggcttggcaggttgccacgattggaagaggatgctaaggagagagacccttggcagtgcccgcgccctgactggcaggggagaagggctagcagaggcgttaggagggtcgccaggtgcacaggaagcctaagaagctaggctgaagatctgggacggagctgctttctgccagcaaatgtccactgtctactgggtggacgggagggagtggagatgagagcgatctggtctctgccctcctttgccaggtcaggcctgagggctgaagtgggagtggccatgtgagtcccagcaaatgcgttttgggattaagcacgcaggtgccttcagcaagcttccccgggtatccccttcccaagcggcaccttcgtggcaggcagggcatctcggaccagggcctggctccagctagctctgtggccttggacagctcccttgacccctcgcccccgcaagggtttcctcatctgtaaaatacaccccgatgtctccagctctgtctaagccctggagttggtgtccccagcagtggagaggggacctaaagccccagggctctgccgcagatgcacccccaggggttccgactcaaagtctggagcagaactgggcagacacagggtgaccgcctggctgtgctttggagagagaagttgggtcccgtgggggtgaatggggccggtcccagaccggttgtccgccccatccgccgacccctcacctccgcagactcctccaagccaggggcctggaagtggctccttctgattcacctaaaggcaacggtggcttgcctcacccccaactccaccgacggcaggagagggtccgcgggggcccgggcccagggaaggttttacgctccgtccttaacccagcgtcctaacctgacccggctgggagagggggcggggccccggaaccccacccgcagacagcccactcccccgcacgcacctgggttgggggaggtggggggcggtggggggcagtgaaggtggggggaggtgggggtgggcccgagcagccggcgcgcccacgtgcctctcccgcgagggcccggccaccccagctccagccaacccgaggccgcctctcgtgccccaccccaagccccgccccggcccctgcaacccgatcctcgccgcggggcggcggccgaagccagctgtcccagctcctgctgtagcctgggggccgggccgccgcgctccgcccatccccgccctcagagctgggcctcgcagccgctagggattgcgggggccgcatttatccctgtgtctctcaggccccgcagagacgggggtggggtgggtgacgccagggaagcaggccccttttcccaagggaagaatccccttccggaggcccgccgggccatggagtttccgcgggtggaggtagtgaggccaagggcacggggagccctgtcgctgccttacgtctggctctaggccggggttcctcggctccaccagcgacatttgtggccggatcgctgtgtagtggagctggcccgggaactgcaggatattgagcggcatccctgaccccctccactggatgccaggagcacagccagccccctaaccctacaaccacaaatgtctctggacacggccaaacgtcccctgggggcaaactctccgggtggaaacccactccccgagggtttttcggtgggcatttgaggcagccacacgggctgggggcctggagctcgaggtccctgcagccaggaagctggtgctggcctccccttctccccggcgctgccagctgcttcaggctggcctgggaactgtgacccttggcctgacagtatttcggcagcatgtgacctgccaggctttctcaccgtagggtgcccccaccctgatgtgggtgctggcacaggggatgctggggacaagcccatcactagcagtcaggccagctggggcaccggaaagagactcaggcactgggtgtccatgggcagcctgaggttcccaagagaagctgggctgaggccgccgtgtgagcccaggggctgtccgggctgaaggtcagggggcatcctggcccacagggtccaccccttacgcgcacacacacacacacacacacacacacacgcacacactgggtggggcgtgggaaagacaaaaggagtcggtcccagctggggaggatcccgccctgtcccttcaccaggcccatttgggagcggtcatcagagccaggaaggtggtgagagggctggggcagggcactgttggccccaacccccactgcgtgccaccctgccatgcaaagcagaattttcagaagaatccaattgcagacttaacgggggaggttttagtagctccccctccccctgtgtattcacaattgactgtatttgcataggaaatctggaaagagacaaaaggcaccatagcagatgttaaagtggaccattgggggagttggccgggggcgtggggggaaagggggtcggatgtgggggtgggaatcccctggtaccaagcagatgagggacaagaagattttttctgtctcgttttgctttttctttctctccttcctttctctcttttccataaaaataaattacatatttttaaaaaaaaattcttctgaaagaaagaaaaggggccaaaggtagcagtggccccccaccagcagctgcagtggcctgcgacgtccctgccccagccttcacaaagaccagactgagctaccctcggccacactccctttcctcatctctccccctgagaaagatgggccaacttttagcctgcctagattttcaactcattctctccttgggagggttttcaaggaggctggggcggggagtgtgtgttcattgcatgtatgtggcatggggcacccaccctccacccagccttgctgaatgattcttcgaaggctgaattagatttacatccgtggagcagattggtgtgctgtttctcagcgtgtagctcatcattataaaacatgctgtgtcccatggggcagacagcaacagacatgggaatagcatttggctcattaattcattcattcatcaggttttcatccatatttatcaaaggctgctccgtgccatcattctaattaacatcaattcccacactgatctctctcctagtatccaagtctgtctggcacacaattctgtcacctcctccaatctgaggcttccatctccacaactcactgcagcccggtgtcctgggtctctgaggggaatctcttactgtgtgtgccagttcctcagctacttgacggtgtctgtagatagtgacctgctctgaggtctgcaagggcaaagtcacccccatccctgcatctgtgttcatgtccctgtgatggggatgatggttcactgatgggaactttggtcacctggggacagctgtgtcctggctttgaaagtgaggctggttggccatgcatcatggctcacacctgtaatcccagcacttggcaaggccaaggcgggggaattgattgaggccaggagtttgcgaccagcctggccaacatggtgaaaccctgtctctactgaaaatacaaaaattagccggggttggtggtgctcacctgtaatcccagctacttgggaggctgaggcaggagaatcgcttgaacccaggaggtggagtttgcagtgggcagagattgtgtcactgcactccaacctgggtgacacattgagactctgtctcaaaaaaaaaaaaaaaaaaaggaaagaaagtaggccagggagatggccggcctgggttgcggtgggggactctctcctttggtcatagtcagaaaggttaagagggtgctctcctgggcacccgtgaagtgccaggtgttctcataacccccgtgcactccagttcgtaaacttgtctgattctagaaatcatctgaatgcatttgttaaaatgacagattcccagtccccaactggagagacgccttattcagctggtccgaggcaggccccagaatctgcattctcagccagtacccaaggtgtttgttacatcagtcaaacttgggccccactactgtaggggaggctgagatgggttaatgctgcctccaccactgcctgggggagtcgggagaaggagctgggtgattgagtgaccaggaggcctttcaagtcatcaccttctcaccttttcagtggtggaggtgggagcttgtgtagggactgtggtgcagggttggggtaggagagagaagagtcaagagatctaaggctgtggtcccccagcttcccccatgactgaggacccatttgaggacaggctggacgtttttctgtatttttcaagggttctgttcactctccttcccgaattcctcaagggggagggtgagcaagtgggctgagaaggaggcacggggctggtgtccaggatccccgggccactgtctccggccgtttccctgcgtctgatagaaggggccccttcctacccaggcccctgggatttctgcctctcaccttttaaggcaatcctttgttttcccgtctttgtttacatgtttcccatgaaaccatgagctcctgaaaaggacatattgcggtatttttatcttcatgtccctatctttggacccagtgcctggctcaatgggggcagccattaatatttgttgaacaaattggcagtgcctgggcactgagcgccacctggcggcgttagcgggcatggtggtgcttagatatcagttggagcggcggacctagggggacgcgtcctggtcccctggtttggggcggcccgtccaagtgtgaggtcatgtaggggtggggtaggggtccctgaacaaggtctggtggggaggcgaggggtgggcctttgaaagctgtgactctctcaggataacaaggggcaggtgggaaaggaagccatggacgctcgggatggagaaagaagaggtctattcaaccatctattcattcattcatttattcactttcagaaccaactttatgggcaggattcagcaggaggctgggacttgtcatgctgagtcctccctgaagggactccctccttgtctgcagagagcttaggtagtccggggttggagaatatctatctccctgaagtggaatggccagccgacttctgcacttcctccaccccgtcctatgcacggtctggtgtctgaaacctcttttctcccactgcagtgccctcccaccctccctcttcctcagggcgtggaatctctgccagggctccactcatggactcaggcatggatgtttttattattcttctttagagacagggtctccatgtgttgcccggccagtctaggactcctgggctcaaaccatcatcctgcttctgcctcctgactggctgggattgcaggtgtgggccaccatgcctgcccccaaaggcccccgaagaattttcatgtgcacccaggcttgagacttctgccagaatctgtgtaagcaaatgtggtcagcgggaccgggaaactgcatcggagttatgtctctttctgcttcaccccacagagctctctccaggtcgctgctgtttttgctacaccctgagtccccaccccaacatatacactctgacctcctgcgatggttgatattgagtgtcaactggattggatggaaggatgcaaagtattgttcctgggtgtgtctatgagggtgttgccaaaggagattaacatttgggtcagtggactgggaaaggcagacccagcctcaatctgggagggcaccataaaagcaggtatgtaaagagcagactggctgagtcttccagcctccatctttctgctgtgctggatgtttcctgccctcaaacattgaactccaagttcttcagcttttggttcttggacctgcaccagtagtttgccaggggctgttgggcctttggccacagactgaaggctgcactgtcagcttccctgcttttgaggttttggaacttggactggcttcctggcgcctgtgcttgcagatggcctgttgtgggacctcaccttgtgatcgcgtgagtcaatactccttaataaactctcctttatatctacatctatgttagttctgtccctctagataaccctgactaatacacccccaaaactacccatgataaaagttgactctcctattctctagaagctagagatctgagcagtatttatttattttttattgtttgagatggagtcttgctctgtcacccaggctagagtgcagtggcacgatctaggctcactgcaacctctgcctcctgggttcaagcaattctcctgcctcagtctcccaagtagctgggattacaggtgcctgccaacatgcccggataattttttggtattttaaataaagacagggtttcaccatgttgtccaggctggtttcaaactcctgacctcaagtgatccacccgcctcagcctcccaaagtactaggattacaggtgtgagccaccgcgcccggccactcagcagtatttaaggttgcaaccttgggttcctgcacccatggccaaaacacatgttcacaaaggggtcactgccagctggtagccctggggcagtgtcccttgaacccagagccttaaggtaaagcatgtaaccttactcagggcaggggagggaggcttgaaacccaggttcctgtctttgtcctctcagtcctagaggcaaggcaggcgttccccaactccccacctgcaccctagcccctcccctctcctggaacagtccagcggaggcaggcagtggagtcacggtgctgcagcctgcttacgctaatgccgcagctggacagtcccaggtcagcctcagggctacaggccttcttgggcattgagagccccctgggtctcctcgactgccaaccaggagcccaagagaccacagaggccaagccgtggcacccttggtccctcctgggtggcctggtctgaaggctgggctctgtgccatttcctcctctgtgacatctttttaaacatttttataatttttttagagacagggtttctctctgtctcccaggctggagtgcaggggcacaatcatagctgtctgcagcctccacctcccgggctcaagcgatctcttgcctccgtctcccagagtgttggcattacaggcttgagccactgcgcccagccctcccctgtgacttctgcctctctctctcctttcatccactcttcctctcccttggagggcttcaccctctggagccttcagataatcttccaaaggggctggaggcttcccctgttcctggtctactggctgggggatctggaaggatccgcatacagatgcctctccacttctagacatgcagagataggaacagatttgcctgtccaagaaagcaggcagttctagcagccaacatcagatggcaacaggggctgcttgtgattagccagtttagactttgcctgggttccaaggagagcagcttctttagggggctgccgactgcaccccttgctggctgctgggtcccactgcctgatttgcatcccctggctccagccactttgggagttaggaacaggactgtgggacccccctcaagcacctccccacaacccgcctgctccagggctaagtttcaccatctggctcaccccagctccattctgtccagcttctgctcactcccctccctgccaccctaagtttttagggccacaatgtgtccacttggggccaaccagttatgggacagacaaccagggatgggtagggggtggggacagagccaaggtggagtgaggtttctttttttttttttttttttttgaaacggagtctcactctgtcgccccaggctggagtgcagtggtgcgatctcggctcactgcaacctctgccttctaggttcaagtgattctcctgccttagcctcctgagtagctgggactacaggcgtgcaccaccacgccaggctaattttttgtatttttagtagagacgggttttccctatgttggccaggctgctctcgaactcctgacctcaggtgatctgcccacctcggcctcccaaagtgctgagattacaggcgtgggcctccggcctggccctggagccagggttctgaagccaggtgagccatcaggagttggagcagagagaagatgctggggtttggggtgccctggagccagataggaatctattgggcacacctgggtccaggctaggccggtactggccagtagaccttgccttcagctgtgttgacatgcagcacctacacacagcactcaattcctcaaccccagagaggtaggaagccccattccttctgttgggagtttctactttggtacttggttagttgacaagcttccctgtttcctctcactttgcaagaaggagggagttagctctttgaaaaactaacaactaattagtgccaggaagggtctaagggggtctggcagcggaggtgacagaaaaaaaaaaaacaaggggaaaggctagcagaggtccccccctagggagttactgcacagtgggctggagtttggggttcaatatggtggacaaatgtgggttcttacaggcaagtgacctcatctctctgagctgtgaggcatatagattcacgtgtgtacatggtgggagttcaacaaacaccttcaaacagccctgaaggttgcacaggtgcattcacatctctgatctcattttaggcctcccagcagcctgaggagtacagggcaggctggagcgctgtgttcccatttcacggccaggaaactggctccaagcaaggacgcacctgcagctcagggctctgaccttccccgccgtgcggcaccattgtcatggtcgtggggcttccctgaggcaggcaccctttacccgcctcccaccccatcctgatccatgatgctatccctgataattacctgggattcatcggagacaccaaagggcagtgccagacagaggccgccctcttcccaccaccacctctatacatccctggagatgggcgtggggtgaggttgagaagtggcttgatgctgtactgatttttttatttttcctttcttttctttcttttttttttttttgagatggagtctcgctgttgttgcccaggctgcagtgctgtcgtgtgatctcggctcaccgcaacctccacctcccggttcaagcgattctcctgcctcagcctcccgagtagctgggattacaggcagctgccaccgtgcccagctaatttttgtatttttagtagagacgggggtttcaccatgttggccaggctggtctcgaactcctgacctcaggtgatctacccgcctcagcctcccaaagtgctgggattacaggcgtgagccaccacgcccagcctgattctttttccaggtatgcagaccactggcctctcgttgaatctgttttttgttgagttgtaactttgttgaaatgcacaaatcttaagcgcttctggtgccttgctgagctccacaggcccccggctattgagccaggtcccgtgccaggctcctctctccaaagcagagaagttatttccaggccaggcccctgtgattgggtttggggcctgcatggagcagtggcaccgtggacaggaaaccctgggggacgctgaggctcccaggcctctgactgtgaccaccacacatctgcctacagcttcctctttctcttcctcttgaccacggtacacccaggaccaagcaggagagcaggtaaccagtcatcgtgaccagctggtgtggactgtgtatggcccggggaccgtgggacatgctggggcatggggtgctgaagctgcctcagcctctggggggtgcaggaggagtggggaagcttccccagagatgggcaggaggccagggcatggtcagtccccaggcagcgtcaggctcttgcagctggtctcacccaggctcctggggaaaggaagcgagatcttcctagtcccaaacctctgtcctttcctaatgcccctccccctgcaaatctcattcagaccctgagtacacaactcaaagtacacacagcaagagtaccaagaggcagtaagttccccccagaggtcagcctacccccactctccatcctgtgctcagcagctgacaagctgttcatcccaatgagggggccacagtcacgccgccctgatcccgcctctcagctctgcgtgcccagcctctgggctgcccttgagtggcacccatggggccaaggccctccttgcttcaagctcagggggaggaaggaacagagtggatggggaacagcccaggctgccctggcgggagggtggctctagagattgggctgctttcaaaagggaagttctgctgagaaactacagcccatccactccccacatcttttctgaggactgggtggttcacaggactcaatgctgctgctgcaggtcttcccagaaagcacccctcattggcctctgagcacgtgtgtccacaccaggaagagactccagagctgatcagaagttttgtggctgctgtgggaccacttctcaccctcacccctgggaaatgggcctcagccctgtggcctcatctcctcctccccctgagtcatgtcacctgatggttatcgggacacagccggaatgtgcaacttccggcaaaaaactctcatgttttgtggttattttgcaccattttgtttcttcctttgggtttgtggacaggatggggtgagcaggatgggcgtggcagggtctaagtcccctgatcccttctcctttgcagtaagtcaggtgtttctctatgtgcctaaggagaattgcatcccatagattaaagtgtaaagcgcacttcctgtggaatccaattttcctattacctttcatcaaaagtagagatatattccctcagaaaaaactgacctgaggatgttaaggaacactgacatttcagtatttgtataatcataataatatttattcccacagaggagctgtcattattgacgttttacagaagccacaggctttgctcaagttcattcggtggtaagtggacaagccacgccagaacttagccttctgcttctctgtctggcctggacgttcaagattgcagcagcgcctttttggtcatggttgaatcaaaaaataatttttgagaaactttgcaatgatcaggccacataagccaccgaatatgacacatctcctgcatttttatgttcagctcaacagtgtcatgatccaaagtgtcttggatctttttttttttgagacggagtcttgctcttgtcacccaggctggggtgcaatggcacgatcttggctcaccgcaacctttgcctctcgagttcaagcgattctcctgcctcagcctcccgagtagctgggattgcaggtgcccgccacattttttttatttttagtagagacagggttttgccacgttggcccggctggtctcgaactcctgacctcgtgatccgcctgcctcggcctcccaaagtgctgggattacaggagtgagccaccgcgcccggcccgaagtgtcttggatcttaatgaggtttagttaatctatgactgcatcatcatgaaaatttccacaatgtccaccaggctttgtcattgaatcttccagcagcagagcccataggtctccttggcttcctgacaccttcgtgggcaaggcgcccctgtgttcagaaggaagaggaaagtgacaaattccaaaaagggccagagggaaggatattcttgggatcccatagctggcacagggctccatgtgggtggacactctgagcttggggactgcaagctcccaggtgacgcattacacattaggagtggcatttcctgtgcccacctggtcattctgtgcaagctggggcacctactcaaggcacgtgtgtgagactgtgtgtgtgtgagtgtatgtcactgtgtgtgaatgtgtcagtgtgtgagtttgtgtgtgaatgtgtgagtgtatttcagttgtatatgtaagtgcgttgtgtgaatttgagtgtttcaatgtgtgaatgtgtatgtgtgtttgtatcagtgtgtgtgaatttgtgtttgtgtgtgaatgtgagtttgtgaatgtgtgtgggtgagagtgcctgtgtgtttgtgtgtgtgtatatgtgtgtgtgcatgaacgtgtgtttgtgaatgtgtgcgtatgtgtgtgtttgtgaatgtgtgtgggtgtgtgaatgtgtttgtgtgagtgtatgtgtgtgggtgtgtgtgaatgtgtgtgtatgtgagtgtgtttgggtgagtgtgtgtgtatgtgagagtgtgagtgtgtttgtgtgtgtttgtgtgtgggtgtgtgaatgtttgtgtgtgtgtgtgtatgtgcatgaacgtgtttgtgaatgtgtgtatgtgtttgtgtgtacgtgtgtgtatgtgtttgtgaaagtgtttgtgaatgtgtgtgtgagtgtgtatatgtgagtgtatgtgcatgaacgtgtttgtttgtgaatgtgtttgtgtgtatgtgtgagtgtgaatgtgtgggtgtgtgtgaatatgtgtgcatgtgagtgtgtatgtgagtgtgtgtttgtgaatgtgtgtgggtgtgtgaatgtgtgtttgtgtgtatgcgagtgtgtttgtgaatgtgtgggtgtgtttgtgtgtttgtgaatgtgtgtggctgagtgtgtttgtgtgtgtttgtgaatgtgtgtgggtgagtgtttgtgtgagtgtgtatgtgagtgtgtttgtgaatgtgtgtgggtgagtgtgtttgtgtgagtgtgtatgtgagtgtgtgtttgtgaatgtgtgtgggtgagtgtgagtgtgtgtatgtgagtgtgtgtttgtgaatgtgtgtgggtgagtgtgtgtgggtgtgagtgtgtatgtgagtgtgagcgtgtgtgtgtttagagtctgcactctgtgtggatcaggaaaggggtccttgcaggctcgctgagtccctgctctgtgcccagccccgagttggctccaatggggctatatagaaaggaaggcatggccggaggacctctgtgtcaagttgaggacacatttccaagactaggaaccattcagggactctggagtcacgatgacaactccccttccctcagccccgaagcccaggcctggacctccaagggactcagggaagggactcaggaaaggggagttccccctggcagcctcctcgtgggcaccaccgagggtgagaggagccagctcagcgggtcccacccccagggttgcccaccttgaccacaaggaaaggagggaggagttattgggccttccactaggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggtgagagtttcccttcccgggaaagtctgcggcagggagggagggtgcgaggggcagggccgcagggcaggtatcacacgagacgccccgagtctggactccgtgcagaacgcagaatgcggtgcgctctgtctaccacataagatggacagatgaaggtccacacccctgggagaggaaggagccagggcctctcccggctctgcacccacgtaccttggctgaaccacagcggggcaagtgataaggggtgggtgcagaaaagggaccttttaggttttcagttgaattcttacaggaagggggacgagaggcaggatgtgtcagggtgggtggagagtggcagccactgactgcgaggggcatgtggtgagggtgggggagatgccgggctcactgggtgcagggtatggaggaggggggtgtggggagggtgggggagatgccggcctcactaggtgcagggtacggaggagggggtggggcggtgagggagatagggtcggggtggggagcagatcgatagtctctggaatgcggagatttaaccagggcagcccagcggctggggcctgagcagggggaagtcccgaggcagccttggctggggttagcccctgcatgggcctgagaaccaggggtcagtcctctccaagaaggggatatgggacagaggggacagaaaaggtggtggggagggcgaggagggaaaagatcgggcagagaagcgctgagatcttctttagggagaagcgtggagttgagtcttccctgtccaagcgcagggattcctcccgcagagtcacctgctgtgccttcagtcacgtccaccgctctcctcagacagctcctgtgcagactcctcaggcctagtcctagggtattgtacgtctttgtggttgctttccttacagatcggaggttttctgcaattatatttgctaactacttgtctgtgggaaggttattacttttggtgtcttgacttggaaacgggtcatcctcccataacaggtgctcctgcgattctcttgggtgttcttctgtttcatagggtcggtgtgcatgggaaggtttcagttcctgtctaatatctgtttctctttctcccattgactcattggctggtacagccggagtgaggcccagcggacatagtggtagtggttgtccctgccttgttgctgactcagggaaaaaggaccagagcttctcattattaggaagaagggatccaccaatgactattcacaaagcatttttacttttatttatttatttatttatttatttatttatttattttttgagatggagttttgctcttgttgcccaggctggagtgcagtggcgcgatcttggctcactgcaacctacgcctcccaggttcaagtgattctcctgcctcagcctcccgagtagctgagattacaggcatgtaccaccatgcctggttaattttgtatttttagtagagatgggctttctccatgttggtcaggctggtctcaaactcccaacctcaggtgatccactcaccttggcctcccaaagtgctgggattgcaggcgtgagccaccaagcctggccaacatttttatttttttgagacagggtctccctccgtcacccaaactggagtgcggtggtgcaatcacggttcactgtagcctccacctcccgggctcaagtgatcctcccacctcaacctccccagtagctgagactacaggtgtgtgccaccacacccagctggattcttaattttttttagggacagggtcttaccatgttgcccaggctggcctccacctcctgggatcaagggatcctcccatcttgtcctcccaaaatgcagggattacaggcatgaaccaccacacctggcccctacaaaacattttttattttatttttatttatttttttggagacagaatctcactctatcacccagggctggagtgcagtggcttgatctcagctcactgcaacctccgcctcccgggttcaagtgattctcctgcctcagcctcttgaataactgggcttacaggcacccaccaccactgctggctaatttttttgtattttagtagagacggggtttcaccatgttgcccaaggtggtctcgaactcctgagctcaggcaatctgccagccttggcctccggcccccacaaaataccatttttattatttatagaaattattattattattatcctttcagctatgaaggaggtgaactacattaggagatctggtcagatgtttgtcttgatttattatgctggcttcatggaaagaattagggagatctccctgtttccgtgttctctgcaaatgtttacataaaattgaaattatttgttccttgaagtttttagagaactagcttgtaaaactgtctgagttttgcttctttttttttgatggaagggaaagaatttcttaataacactcatcatttttggtctacattaaaaaaaatctagctgggtgcagtggctcacacctgtaatcccagaattttaggaggttgaggtgggaggatagcttaagcccaggagtccgagactggcctgggcagtatagcaagcaagaccccgtctcttaaaaaaaaaaaaagtctattcttggcctacattgatgatttatattttcctaaaaaatcatcagtgtcgcccaggtttgcagacttatttgcagagatttgcaaatttttcttttgaattttatatctgcgtcttctttatttttggtctgactacctactagtctaattaattgtttgaggccaggcacgttggctcacgcctgtaatcccagcactttgggaggccaaggcgggtggatcacttgaggtcaggagtttgagaccagcctggccaacatggtgaaaccccgtgtctcctaaaaacacaaaattagccaggcatggtagtgtgcaccctgtagtcccagccactcgggaggctgagacatgagagtcacttgaacccaggaggcggaggttgcagtgagccgagatcatgccactgagctctggcctgggcgacaagagcgaaactctgtctcaaaaaaatgaaataaaataattaatcatttaccccttacaaaaaaatccatttattaatgtatatactaactccactgtttttctgtttcttaattcactgatttctgtgaattcaccagttcgtgaaagatgacctggttctttctgtgttgtgtgtgggtgtgtgtgttcctcttctgacctcttgagttggacaattcagtcatttacctgagagttaatgggtcaagattctgtgatcttcaaggaaaacgttaagacgacagaggaatatcctggtagaggaccctggccccaaggtggtccccagtctcctgtttatgattagaggggtttggggtggtgattcaggttggaagagagaaagcgcagaaacacaagcctgggagcactggggatccatgtgatcgttccaggtaagtggggaagtaaatggagggttttctgacacttcgcaatctctaaattataatgacaccctcacaggtggaacagagctttggggagatgattgggtgacagttttttatccaagatttcagagaagagaagttaatcaggagagagagaaagagagagagctagagggagagagagagagggagaaagaaactaaatccgaagggaagtcagacactggaggtaggacgagagacaggattgggtgcagtgggcagaggtggtggggtcactgaggtcaggagagaagccaaaacatggacaaagaaagatgacgattcgcagcccaggagaggcagggaatcgggtcaggacagggagcaggaacagtgtcttgggtgaaggagggctgggaactgacagtttttatttattttttttgagatagagtctcactctgtcgcccaggctggagtgcagtggtgtgatcacagctcactgcaacctccacctcctggactcaagtgatcctcccgcctcagcctcctgagtagctgggaatacaggcacgtgccaccatgcctggctaattttttgtgtttttggtagagatgggggtctcaccacattgcccaggctggcctcaaatgcctaaggctcaagcaatcctcccactttggcctcccaaagtgctaggattacaggcatgagccactgcacctggcctatttatttatttgagtcagggtctcactctgtcacccaggctgaagtgcagtgatgcgatcatagctcactgcagccacaacctcctgggctaaaatgatcctcccacctcagcctcctgagtagctgggaccacacgtgtgcaccagcacacctggctaatttttgtatttttttgtagagatggaatctcactatgttgcccaggctccatttacttattaagtacttaatatgtgtcaattttagtgatttgtgtttttctagaaaataactttcatctaagtttatgaattttatgtagagaatttctgcaaaatatcttgactcttcattctttcttcatctatggtccttttctcttgtcatgtcttatttagtcagcccagaggttatctatttttattagctggagtcatgtgaaaccctgttgtcttggtcaaaaagtttaatatcagccatttcatgtgattcaacctaatgttatttaccaggcattttatacctgtgatctcatttaacaccctcaaaggccatatgagtcagggacaattgtcaccactctatagacaaggtgtctgaagctcagagaggttaactaacttgccccagaacacacagctgatacgtaatagggtagagatgtaaacgcagatggttctgaggatctttctgctttgtcctggcaattgctgctgagagcctcaggaagcatcacacctgtgacaagcttagaaaggccttctctgcagggggatgtgtacatccaggcgtggagaggtttgggtgggactctgggagaggcacagaggagcttatctttgggcagccgtgggctgggtgtggagctagtggggtccaggagaagcttgcactgaagtttttgtagagggcctacaggtgcaaggcacctgtagacgttgaaggtataagaaggagacccctaccaaagtctcatgtgtgaggagatttagcatctgaaacagtaagtaaaattaaagagttctggccaggcgcagtagctcatgcctgtaatcccagcactttgggaggccgaggcaggtggatcacctgaggtcaggagttcgagaccagccaggccaacatggtgaaaccctgtctctactaaaaacacaaaaattatccgggtgtggtggacgcctgtaatcctagctactcggtaggctgaggcaggagaatcgcttgaacccgggaggcagaggttgcaatgagccgagatcccgccactgcactccagcctgggcaacagagcaagactccatctcaaaaaaaaaaaaaaatcaaagagttctaacccaaggaaagaagagcaagcccccatccccaccatccttgaacaatatggggcctaatcacagaattacaagggcattgagacactgcacacacaactgcccagcaggcctgtgcccatctgcctggggcaggggccatgtgtcctctgcttggcagccaacactagcttcgagccatcaccttactctccttgctttgcatctgataattatttgggaaaatgtcagacataattttcaaggaagttcatttatttccgagatttaagtctaggagagctgggcaaactaaggtaagacacaggatgaaagttttcgtcagcaagccttctgcgtttgtgactctttttttttttttttgagacagagtctcaccctgtcactcaggctggagtgcagtggtgccatctcagctcaacataacctccgcctccagggttgaagcgattcttgtgcctcagcctccccagtagctgcaattacaggcgcatgccaccacgcccagctaatttttgtatttttagtagagacagggtttcaccatgtcggccaggctagtctcgaactcctggcctcaagtgatccacccaccttagcctcccaaagtgctgggattacaggcataacccactgtacccagccagtattcttgtcaaaatggcttgacaaccctattactgcccgggtttgccccttggtgggaccagatcagtgtgtgggccggtcttcctcttgcagggttgcccagggctggggtggccctcccgggagtgcaggtgcttaggggtgagttctcatgctcctggcaggtttggaagcaggaggcccctggtgggtgagaggggtgggaagggtaagggaaaggaggcagggggctggagaaaggggctactatgagcaaaatcttgagggtggtagagcagaaaagagaatactcaagctgtgatctggctgatggggctgatatgaggtgaaggagtcaggggctgagggctgggggtgctgatgtggagtcggggaatctttggaggaggtgactccagggcacccagcctgagctcttccggtctccatggaaagcctctgccccattcccacctgtgtgcggaggtagcctctcatcctcagtccccgctcctgggtggacaaggcctctctgcctgccgctgcctcctccacacccccagggtccatgcggccctgaccccagggcacccctgaccaggctcatctgaggaggagctgggactctggcttgtgttttccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccgggtgagcccctccttccctcagcgcctaaataggctcaggttggaattgttggggcaggaatcagatcagagacgtgaagcagacagtgtgtgtgtgtgtgtgcgtaagagagagagaggtgggggccaggggaacacagtcagggggtctctcctggagcagctgacatgtctgcccagtattgaagaagggaagggtccagtgacagggaggctgagagagcgttgcctgtgaaggagccaggagcgcacctgtggctcagccccaacggaagtgcagctgagtgggggaggggtggggctgaacagagaggctggggggccagatgggaagctgctgtcctcagggggagccttaccacatgacaggtcagatttgcagtgtagacagactcctctgcagcatggagtttcgcaggagcacctggaccctcatcagcaggatggaaaatcaggaccactgggagtggcacccgtgtcctgttcagaaatgcccagttggcccaggagggtcctggagagactctagccccagggtcctgcatcctgcccccttccttagtgggcagtttgtgtgaaatcaaaccaaaaaggcatcctgagtggtgggagagccagaggacagctccctgggtctgacttgtggttttgccaccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagtaagcaccctagcccctgagacatggagggggccctgtgctaagaggaggagcccagggcggggaccttggccatgtgggccagctggaggtgtgcatcgctccctttgccccaggcccaggttggaagccatagtctgaacaccccggcttggacctgcccttggctttggaagggggctcaggtaggggggaagttggggggcagatggaaggaaagtgatagttactgacagctggtaacatcctacgaggcccgtgttagatgcttcacatgagtattctcacttgcctttcactgcagccctgtactgttgtcattccgtgtattagtctgttttcgcaccgttgataaagacatacccgagactggataaattataatgagaaagaggttttaatgtactcacagttccacatggctgaggaggcctcacaatcaaggcagaaggcaaaaggcatgtcttacatggcagcaggcaagacagagaatgagaaccaagcaaaaggggtttcctcttataaagccatcagacctcgtgagacttattcactaccacaagaacagtatggagcaaaccacccccatgattcagttatctcccactgggtccctcccacaacacgtgggaattatatgggagctacaattcaagatgagatttgggtggggacccagccaacccacatcaatccccattttacagatgagtaaactgagactcagcgaggtgaagcaatttgcccagtcaagtagctacaagaggctaaggctaagcttccaattctggtttatgtgactccagagccttgagttctcctctctaaatagtggttcttaacctttttcgggttcaccaaccccacatagaatctgacatctatggacactctccccagaaaaacacatgcagtcacaaaccttttctgggattcacggactccctattctagcacaaaaccccacaattccatcctggcactatccacccagagttagtgcagaccccacaggtgaagagcttccacatctaaatcagatcccacaagaccgccctgatttagatgccagtcgaactttggggatccccaggccaccacacttctgaccaactggatgcaaatttgggggttcccaggacccccccaggttcaataatttgttagactcagaactctggaaagcattatacttacaattacagttttatcataaggataaaggataaagattaggaccagccaatgcagagacacataggacaaggcttgggaggattcccaaacagtttctgtgccctctccaggtggaatcagggagcatcacctgcaccctccctgcggcacctcaatatatttatcaaccaggaagctcctccaagctttggtgtccagagtttttattggggtttcattacataggcatgatgtgattgaactgtctccacctccagtccctctttgggaggttgggctggctcagggctccaaatctctaattacgtagttggtctttctggtgaccagccccatcctattgtctcatctcttaccaaagtccaggtgtgattcatgaacaacaaagacactcctaatttttgggacattccaaggatttagagcctccctcctaagagctagggacaaaggccagccagattctttactggacaacatccataaacccctccacaggcttctgccaacatataagacaaggcaaaattcaggcttgaacatgccacttccagaagtttagcctgtagatacacataggtggcagcgctgagttctgtggggcctgaaggttgtgcagtttgcggggtgggttggtgggtgggtaatctaagaaaaagatgagaaaattatgaatgcaaacgtaggcatgaaggaaagggcccaagcaatggagggacctgaagctgggctgcatcagcctcctggtcaatctgctgctgcgtggtcaggtgtgaaaaggtggagctgcaaggcgatttataagcaacgtttaccattgcaaaggactggggaaatgcccattcagtgggaacatttaaataaatcacagtctatccatgtgttggaataccctgcagctataggaaagagtgagggacttctttatgtactgacgtggaaagacctctaagatgtattgctaagtaaaaccagaatagtgttagacgaggcctcctttgtgtgaaagagaaaggagatcccgtacattcgtatttgcttgtatacacataaagaaactctggaaggttcttaagaacagcacgtgtgtgtatgtggggaaattggggaatgtgtaaatggggggtgtgtagaaagggggctttatactgtctattttttttaattgaccttatctatctacttaaaaagttagagaaggagaccaggtatattggctcatgcctgtcatcccagcattttgggaggctgaggcaggagggtggcttgagctcaggagtctgagaccatcctgggcaatatagcaagattgagtctctacgaaaaatttaaaaattagccgtggtggcctgtgcctgtagctggaggctgaggcaggaggatcacttgagcccaggggttcaaggctgcagtgagccatgatcaccactgcactccagcctgggtaacagagccagatcctgtctcaaaaaataaaaataaaaaataaaaataaaaaagtaagttggagaaggcaagttggccccgcccttaccatcctgtgcctcctccaggctcccgctgctcctctccctgctggcattgttgctgcttctgttggtgggggcctccctgctagcctggaggatgtttcagaaatggatcaaaggtgagttggctccccacacccctctgccccacctggggtggtcagaccctgaccacagacgctcatcttcaaagctatgtccacgtcccacagtattgctatgacatgtgacacccagaccacacatcctaggtgatcctacagggcaggtcccatgggaggcatccttgtgcgtggtggttacaggctgtgagaggtggctcccaagcaggaggctttcccacttccaggccaagggtggttgccccatgaagcaatgaccctcttctgtttaaaaccctggcatggtgtgctgggtgcagtggtgtgcatctgtagttccagctactcaggaggctgagatgggaggattgcttgatcccaggaattcaagaccagcctgcgcaacacaacaaggctcccgtgtctataagataaaataaacccttgcatggtctcccccaccataaaaagtccaggtatctacaggagtcactgccctccacgatctggctctacccacctccctctccccatccgcgcaccctggaaaccaacttcttgtatctcctttaatgacagcctcaacctcagcctctcctctccttctgggtttgctctgggctggagggcctcccctgccccctctccccagctcactcccagtggactccaacagtggtcctcagactttcttttctctgggaccttttctttgactccaaagagtggcttggggcccctcctggctatacctctgctgtcacagccttttgggaaccagactgtcattgctggtgtcctcatctgccttcccacaggcatgtgcttcaaggaggtacagaaccaatatttgtcaaattaatgtgttattcagtatctccagctgcaacgggcaccccaggggcctccaggcaatctctagtccagctgccctcctctgagctcagattaaaagagagaacaggaactcttggcactcagtaagtagatgctcaataaatagctgataggcaaattgaataagcacaggaacagaggaacaagtggaggtgtggccaccagtcctctagattgcagatccctggccgaggtcaagtgtaagcctgaagcttcctccctgttcggagagttgaagattccacaggcagaagattctcaggggaatctttgtccaaagccttccaagactgcagtgagactggggtgggaagagatggggttatcctgtcccatagctgcaggataagctgctgcatgcttggtggggggcactgctcacacatatccccagtgcctcctgtggcgcccaggcttttggcggagaaatcagcctcagtagatctgtgcagggtgtatgggaagaaaaccacttcctctttcccatctgctttgtgtgtgtcattttctggtaatcccatcctaaacttcagcacccacgtggatgccactgggttgtctcagttctgagcccctttcggtttcctttgtgccctttcacccagaaagtctctggctcctcaaagagcctcctccccccttgaaaaggatgtatgtgattattgtaggaagtttgaaaaatgagcaaaagcacaaagaaggaaataaatcccccatcatcgatgataactaaaaaccccaccacctagagaaaaccagccactggcccctgaggtatatccttccagtctttttttctatgcctatgtaaatgcatctatgatttctttttttttctcttttttgagacagagtctcactctgtcacccaggctggcgtgcagtggcatgatcttggctcactccagcctcgaccccccactgcccggggctccagtgatcctcctgccttagcctcccaaatagctgggactacaggtgctcaccaccacgtctggctaatggttaaatttttttttttaagagatggggtttcactatgttgcccagcctggtcttgaactcctgagctcaagcccagagtgctgggattacagatgtgagccaccacacccagtcatgcatctgcgatgtcttaacaaattggcctcataccactcattctcttttaaacctacatttttgcacttaacatatggtaccatgttcccagctagtaaatgttctaaaaatcacagacgcagagtttactggtgtcttaagcttcctgtaacccatcctcagtaacaagataaaggctttctattcaaacatttttgactctctgtcccctgctttgcaagtccgtgccccatcccctgactgtgtggctggggctgacttccccttgccctgcctggagcctgacacctgcctcatcacacctactccccactctttcccccagcccacatttgtcgttcattcattcgtacaacaaagctgtcctgagcacctactgtgtgccaggcctgtgctgggccctggggacaacattgtgactggggtagactgggtcttaccttcagtgagcttcccctaccgctggctcccccaaaccttctcactaccaccctccttcccgggcgttgaactcctgtctcttccccaccagctctttttctccttcccatcagaacacttgtcccaggtggggacagggagggcagtgtggtgcctgcgcacagcacttggaagcagggcacttcgcaccccagagtacccggctgcgcactccattaggtcagctgtggctcagcaagcccgtcactatacgtggtcttgtgtctcccaaccgtgggctcctcccctttaattctgggggaggagcccacagatccccacagcatccagtgcagtgggctctggggttgcctggctgtggacctaaccaagggcatcagcagcgtgtgtgtcacccgctgcccacgtggtccgggctcctggggtgaaagggttagggtgtacagggctgtgctcataggcagcacccttatagagcaggtgccagcagccaagggctgtgtgagcctgagctggcgtccctggggctgacaggcctccttccctacggcctggggcagcaggcaggtgggctgtctgggagggcagacctcaggcacggggatgggagcagaggccccagcaacttcccacagtctgatgcagccctaagccccagatgcacagggcttttcagtggcatccttcctcccctggaaacatttgtgtgagatcccgtgttgagagcttgttttggtccctctcctccagctgggagctttctttcctttctttctttctttttttcgtttttgagacagagtcttgctctgttgcccaggctggagtgcagtggcatgatctcagctcactgcaacctccgtctcccaggttcaagcgattctcctgtctcagcctcccaagtagctgggactacagggcgtgtgccaccatgcccagctaatatttgtatttttagtagagacagggtttcaccctattggcccggctggtctcgaactcctgacctcaagtgatctgccctcctcggcttcccaaagcactgggattacaggcgtgagccaccgcacccggcccagctggaatctttctatttctccatttattcactcatcctgtgctcgttcattcatttactaagtcactaattcactcactcaacaaacccttgagttcctaccatgcttcaggcctgaagggataggtccccagggctgaggtctctagggaaaggccttttcccagaaggcttgtaaggtcctccatcctggccattgttccgggattcaacctccttcctctcctcttgtctctagctggtgaccattcagagctgtcccagaaccccaagcaggtaagggggctttagcaggaggtgtatcaggtggctgggcggagggtacagaggctgctggggagttggacagtcccatcggccaacggaggttggatggagcggggagctcacccagagcaggacgaatgatgctgggagatgtggtcactaggtcttgttctgagtcctggccagcctgtcccctccccaccaaggcaaatggaatgaagggaggccctcccagccaagctgacctggggaacattaaactactggacggagtggggtggaggcaggaaggggaaggtgggggctgaggtgctcagagcatagaggaaggggagacacatgcagagacgcagggacagaggctgcagggctccgtggacacccacctgggacctcctgcccacccaggctgccacgcagagtgagctgcactacgcaaatctggagctgctgatgtggcctctgcaggaaaagccagcaccaccaagggaggtggaggtggaatacagcactgtggtaagtgcaggagcccggcttttgggcatgcggcccctgggctgtgccagggcacccctgggagggtgggcagaaggggaaggaaggggtcggcttggtgatcttgtgcctgtcagggacagggccacatggagatggagcaagtgtagattttgccagagcagaggtccttaggagggcttggtgtcattgtggtggggggtttttgggggtggccagcagctatggctctgacagtccgtgaagtccagcatgggttaagcacctgctgtgtatcgtgagccaagctgagaacctgtgacttctcactgttttggtctcatcatctctttgacatcaattctgctttcgggtttttgtctgtgacccgctgtgggtcaacccttgggcgcagccaccttcaactgggatgatgggatgggggctgcctccctgggtcgtgacccacctgctagtgggagagttcaagcagaagctgggggtcacttggcagagaggatcgggagggatgtaagcatcagcagggaagcttaaagtgcccccaggcctgggagctgaagaggcccctcagacaagtcgtgtggtgccatggagggctggcaccagggtgacaggggacattgttgctggtctgcctggaaaagtggcccaactccctgggatatctccagcctggtaccgttctccccaggccgccgttttgcacctgacaggagaagaggggatccagacctgccacttccgggtcccctgatagccgcaccgttccccaacctcccgccagctgtctgcatgaggatgagggtggtctgggggcccagggtcctggatggctcctggccaagttccttccttccttccttcctttctttctttctttctttctttctttctttctttggaatctcgctctatcccccaggctggaatgcagtggcacagtcttggctcactgcaatctctgcctcccaggttcaagcaattctcctgcctcagcctccagagtagctgggactacagacacctgccactacactggctgatttttgtatttttagtagagacggggcttcaccatgttggccaggctggtctcggactcctgacctcaagtgatccgcctgccctgacttcccaaagtgctgggattacagtactgagccaccacacccggccagctcctggccaagtttctgagcgcccctgcactcaagcctgactccttccttgcatgacatgatcttgtgtccacgaagctgcatggcctgggaccagcaacagccttgttctaacttgttgtctcatgatttaaagtggatggcacatggtcttactcttctcccagcccccttggtacaagttgggactcatgcccacagtacagcaagttaatcagagctgcagggccaacgcagtacccctgtactggcttcaactccacctagagaacgaggggtcctctgcagaaagggatccatggctgcttcgttgtgagaactttcctttttttttcttttcttttctttttttcttttttttttttgagacagagtcccactctgtcgccaggctggagagcagtggtgcaatcttggccattgcaacctccgcctccccggttcaagcgatcctcctgcctcagcctcccaagtagctgggattacaggtgtccaccaccacgcccagctagtttttgtatttttagtagatactgggtttcactatgttacccaggctggtctcaaactcctgacatcaagtgatccacccgccttggcctcccaaagtgctgggattaagggcgtgagccactgtgcctggcctcaagaatatttcattaagagaagcacagaggtgtcttgggggagcccagccaggtctcagggcctcagtttcttccctgtagaatggaccaggctgggtcagccctgaggagcccccggagcctcctgcctctgatgctggggatgttgtgctgctgcttgcccagttggggaggagcagctgggtggacaggatcatagagaaaaagaggccaggacagtggagcctctacagtgaggcctccccaaagcccctcaggtgtcctccctcctccatcctatgttgggggtcctttcttcccttgcctctcccaagtcttcagtttcttggtttctctctgcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcctgctatgtgtctgcaatcctctgcaaaagaaagctcccagctttgataccagatgagtgcagagaagccttgtgggtgcagtgggttggggacatcctaagagaagtcctcactgagtgggagaaggtgggtcacagctgcttcttgccatgatgtctgtttgcttgtgtgttttttgagatggggcctcgctctgtcccccaggctggagtgcagtgatacgatcacagctcactgcagcctggaattcttgggctcaagtgatcctcctgcctcaccctcctgagtagctgggactacaaacacatgccaccatgcctgaattttttttttttgtaaagatggggtctcgccatgttgcccaggctggtcttgaactcttgggctcaagcgatccttttgccttggcctccctgagtgctaggattacagcatgagtcaccatgcctggcagtttgcatgatggaaaacacagcagttttcttgtcgggagatttgaaatttaatgcaaagagttgtccaggctgtcttgagtctgtggcagctgccaacagctttatgtttttattttttcattttaatttttcttttttagaggcagggtctctctgtgttgctcagccttgaactcctggagttgtgcaatgtggactcctggatctgaaaggtgaggctgccatgaagcctataatgtgggtcggggcttagacatgtgcctggtacggaggggaacccagaaatagttgttgacttcacttgaattgagcccggtcacgtttcagtcctgatctgcagtaacccttctcaggttcctgtttccagagacagaattccacagggtggtttaaaacacagaggttcgtggcaccagactgactctaagactcaggggattgttcgaaggaccccttctcctcaatgggagtgaactttaattctctgaaatagtattttctctttaattcggtctaaatttctatcaattagaagtaagtcctctgtaaaatgcaaatgtctaggctatcagttggttgtcaatgccggctgctataactaccacaacctccacaataaaactgggtggagtggcggggtgaggctggggcaggagggtattgcagccacagccacacgctggccccagccccctgccccgtcaatctctaaggcttggtggtggaataagttccccggtataaaccatttgccctgtggaaggtggcagccccttgggagtccttcatgtcatttccttgccagagagtctcagttgggaccacccccattctccaaggaggcctcatagcaggagggagcgggctggcttgcaatagtcttctggaagtcttactgtccaactcccttccaggatgctctgcataccaaaggacactgggaagaaccatctttgtcaaaccagagacagggtcttcatctgttgcccaggctagagtacaatggcacaattattgctcactgcagcctcgaactcctgggttcaggcagttctcctgcctcagcctcctgagtagctggaactacaggcatgcgccaccacacctggctaattttttgtagagacagggtttcatcatgtggcccaggctgctcttgaactcctgagttcaagcaatccacccacttcagcctccgaaagtgctgggattataggcatgagctaccatgccctgcccacactcaaaatttacaggagaatatacagtgaaaagttggtccctttatttctgtcaccaggcatccagagataaacaaggttaatagtttcttgtgtttctcccctgagatagttaatcatttgcacatatatccatgtatatacggcctatatgtatatgctcctccccattcccatatgtggggatatcctccccattcccaccattcctgcacagtagtattttcatgtcacaaccatcttggagattattttaccttcttctataaatgctgcagaacatcccataacattccattgtttgtaccatgacatacacatgccattttgcacattttcatagacagctgaagggtaaagttggagaaattcaaagtccgtgcacttgtaattttgatagatattgccaagcatatggcaactttaaatagcaatctttggccaggcatggttgctcacgctgaatcccagcactttgggaagctgaggtgggtgggtcattcgaggtcaagagtttgacaccagcctggccaacatggtgaaaccccatctctactaaaaatacaaaaattagctgggcgcagtggcatgcacctgtaatctcagctacttgggaggctgaagcaggagaattgcttgaacctgggaggtggaggtggcagtgagccgagatcatgccattgcattccagcctgggcaacagagcaagaccccatctcaaaaataaataaataaaaaggaaaaaaaaagaaatagcaatctttttatttatgtatttattttttgagacagatcttgctctgtcactcaggcagagtgcactgagagtgcagtggcttggttacagctcactgcagcctccacctcctaggctgaagcaattctcccacctcagcctctggagtagctaggactacaggctcaggccaccatgcccggctaactttgtttatttttttctgtagagatgaggtctcactaggttgcccagttggtcttgaactcctgcactcaagtgatcctcctgcctcagcctcccaaagtgtggggattacaggtgtgagccaccatgcccagcttgaaatagcaatctttaatttccaccttactagttatccctctacacccaaaactgacgtattaatttttaccaagtgtattagtttgttttcatgctgctgataaagacatacccaagactgggcaatttacaaaagaaagatgtttaactggactcacagttccacctggctggggaggcctcaaaatcatggcagaaggcaaggaggagcaagtcacatcttacatcaatggtggcaggcaaagagagagcttctgcagagaaacttccatttttaaaaccatcagatctcataagacccattcactatcagaagaacagcatgggaaagacctgcccctgtgattcagtcatctcccaaaacaagttggaattatgggagctacaagatgagatttgggtgtggacacagagccaaaccatatcatttcactcctgacctctcccaaatctcctatcttcacgtttcaaaaccaatcatgccttcccaacagtcgcccaaagtcttaactcatttcagtattaactcaaaagtccacagtccaacatctcatctgagactaggcaagtccctttcacctatgagcttgtaaaatcaaaagaagtttagttacttcctagatacaatgggggtataggcattaggtgaacacagccattcggtgaacacagccattccaaatgggatacattggccaaaacaaagggcctacaggtctgatggaagtctaaaatccagtaggacagtcaaatcttaaatttccaaaatgatctcctttgactccatgtctcatatcaggtcacgctgatgcaagagatgggttcccatggtcttggacagctctgcccctgtagctttgcagcgtacagcctccctcccagctgctttcatgggctggcgttgagtgtctgcagcttttccaggtgcacagtgctggctgtcagtggatttaccattctggggtctggaggatggtggccctctactcacagctctactaggcagtgccccagtagggaccctgtgtggggtctctaaccccacatttcccttccacactgccctagcggaggttctccatgagggccctacccctgcagcaaccttctgcctggacatccaggcatttccatacatcctctgaaatccaggtggaggttcccaaaccccaattcttgacttctgtgcacttgcaggctcaacaccacatggaagctgccaaggcttggagcttgcaccctctgaagccacagcccaagctctatgttggccccttttagccatggctggagcggctgggatgcagggcaccaagtccctaggctgcacagagcaggggaaccctgggcctggcccacaaaaccactttttcctcctaggcctccaagcctgtgatgggaggggctgccatgaagacgtctgacatgccctggagacattttccccattgtcttggggattcacatttggctcctcgttacttaggcaaatttctgcagccagcttgaatttctcctcagaaaatgggattttcttttctatcacattgtcaggccataaattttctaaacttttacactctgcttcccttataaaactgaatgcctttaacagtgcccaaatcatctcttgaatgctttgctgcttagaagtttcttccgccggataccctaaatcatctctctcaagttcaaagctccacaaatctctagggcaggggcaaaatgccaccagtctctttgctaaaacataacaacagtcacctttactacagttcccaacaagttcttcatctcaatctgagtccacctcagcctggatttcattgtccatatcattatcagcattttgatcaaagccattcaacaagtctctagcaagttccaaacttacccatattttcctgtcttcttctgagccctccaaactgttccaacccctgcctgttacccagttccaaagtcacttccacattttcaggtatctacagcagcaccccactctactggtaccaatttactacattggtccattgtcacgatgctgataaagacatacctgaaactgggcaatttacaaaagaaagaggtttaacagacttacagttccacgtggctggggaggcctgacaatcatggcagaaggcaaagcaggagcaagtcacatcttgtgtggatggcagcaggcaaagagagagcttgtgcagagaaactcctatttttaaaaccatcagatctcatgagacccattcactatcacaagaacagcatgggaaagacccgcccccaggattcagtcatctcccactgggtccctcccacaacacatgggaattatgggagccacaaggtgagatttgggtggggacacagagccaaaccatatcaccaagactatataagacctctatggagagaacaataaaattccaataaaggttacagaagatgatctgaataaatggagagatcttttaggctcttacttcaggtgacttaatgacaccaagatgtcgagtcttcccaaattaatcaatatatttgaccgggtgcggtggctcacacctgtaatcccagcactttgggaggtcgagatgggcggatcacctgaggtagggagttcaagaccagcctgaccaacatagagaaaccccatctctactaaaaatacaaaatagccgggctgaattagcttgttgggaactgtagtaaaggtgactgttgttatgttttagcaaagagactggtggcattttgcccctgccctagagatttgtggagctttgaacttgagagagatgatttagggtatccggcggaagaaacttctaagcagcaaagcattcaagagatgatttgggcactgttaaaggcatcagttttataagggaagcagagtgtaaaagtttagaaaggttgaattagctatttgtagacctttattccattgaatgcattttaaaataagcttattatgttcctcaaaaaaattcctttttattaggagtgtattgaatgtattgattttttttttgagatggagtttcactctttttacccaggctggagtgcaatggcacgatctcagcccactacaacctccacctcctgggttcaagcgattttcctgcctcagcctccctagtagctgggatcacaggcatgtgcaacctctgcctcccaagctcaatagatccttccacctcagcctcctgagtagccatagatttgaggaaataatgaggagccagaggaaactgtcccgtctcagactagaaaaggggtggcctgaagcggagatggggaggggagagagcgcgagctggtgggacccagggctgggccgacctggagttgccaagagaatctgcaggagacactgctgcccagtacagcaaccacaggtgagcatggagccctcgggaccggccagtccaaactgaaatgggctttgaatctacgacttactgcaaacgacaggatgtcaactatctcattgataacacaatgagtacctattggactgaaggactttgtgtgtgtgtgtgtgtgtgtgtgtgtgtgtgcatatacattttttttttgagacatagtcccagggaggagtgcagcagcatgatcatggctcactgccccttcaaactcctagacttatgtgatccgtctgcctcagcctcccaagtagctgggaccacaggcgcatgccaccaggcctggctaatttttttgattttttctagagatggactctcacttttttgcccacactggtcaaactactgggctcaagacatcctcccctctcggcttcccaacaggttaagattacaggcatgagccactgcacccagcctgataatattttgggggtaaataaatattggggtgaataaataaaaatattatttcaaatatcagttatccaaattgattatgtaatatttaatcaaattgattattgattattcaaatatcaaaggtgactttgatcttgaattcagttaattgagccttaggagattacggacccctgtaaatccaagctccctgctcctttctattcactggcattctagactcattcaccacacacattaactaacagacagatgccagcgtcgtgctttacctgttaaacagttacgagtctggttggtacagccagactgtctctgtctgcatgagccgggtacagaaaggggccactccagtgttttacagatggttctaatatgttattactaaacacttgccacaacagcttgcataggcagctgaggtcactcggtcacctcaacattctgtgatcagccacatgagctgttgggttttaccaggaaaagagtgactagttatgcttctcttttttaattttaatttttttttttttgagatggagtcttgctctgccacccaggctagagtacaatgacacgatctcggctcactgcagcctctgcctcctgggttcaagcgattctcccatctcagcctccagagtagctgagattacaggcacatgcctccatgcccaactaatttttgtatttttagtagagacaaggtttcaccatgttggccaggctggcctcaaactgctgacctcaggtgacccacccgcctcagcctcccaaagtgctgggattacaggcatgaaccgccactcccagcctcctcttataatttatttaaaaggccatggtgctttatagaacagcttaacaattactgagaagaaagaaagaaggaaagaaagacagagaggaagaaaggaaggtaattcacatgcagagagaacattccactttattctttttgtttttttcagggaatgggtgagctgaggggtttattcacacaacagaatgctttgcagcagtgacaacagattgcctttttttattttatttcattttattttatttgagacagggtcttgctctgtcacccaggctggagtccagtggtgcaatcttggctcactacaatctctgcttcccaggttcaagtgattcttctgcctcagcctctccagtaactgggattacaggtacatgccaccatgcccggctaatttttttgtacttttagtagagacagggtttcgccatgttggccaggctggtctcgaacttctggcctcaagtgatcctcttgcctcgatctcccaaagtgctgggattataggcatgagccaccatgcctggccaccttctttattttacagaagagccacgggccagagaggctacttgaaatgacaaatgccactccattgggtgataatatctgaaccttgaatctaggaattctggatcttagcattaaaaacaacaacaatgaaaaaaaaaaccttgtattttgaaacaatttcaaacttaaggaaaaattgtggaaaaggtacaaagacctcccgtatgtcattttcccagatttacccttttttttttttaatttgccacttttttgttactctgtttctatctatgcgtttttccccagaaccatctgagaacaggttgctgacactgtctttgtctgcatgtgccgggtacacaaaggtgccactccggtgttttctgaaagtagctggtgaagccttcccgtagttgtgccttgtctttgttttacaatccaagttcaccttcaaaatacagcgcctcacttggcatgtccaatgccaacatgatagatattcggaggattaaataatgttaggttaatcatcaatatgttcacaattggtccaaggaggtgaaagacattttctaattagcccaagccttttagaaagatgactcagggctgaattatccacagtttagaaaatgacctcacaattatgtttctttgtttttaaagtttactgtttgggcaaacaccagccctggtttgtagacctgactctgcctgggaaccaaacatagagatttgatagccacgtatctccaccctgtggccatgcggggaatcacacatgcctggattcccaagcctgttgaattcgttggggttggtctgtcaacgccaaaggaattctgtactttctgggtcaatgcagctgagaagcgggagggcttgaaacaggggaacagacagaaaactcctgcatggctttccagcccctctgcacgcccagtccttggatgttttgtgccgaaagaaaactcaactccttggccgggcacggtggctcacgtctgttatcccagcattttgggaggccaaggcaggcggatcacttgaggtcaggagttcaagagcagcctggccaacatggcgaaaccccgtctctactaaaaatacaaaaattagccgggtgtggtggcggacacctgtaatcccagctacttgggaggctgaggcaggagaatcgcttgaacctgggaggcggaggttgcagtgagccaagatcgcgccattgcaccccagcctaggtgacagagcaagactctgtctcaaaaaacaaacaaacaaacaaaacaagaaaactcaactcctctctaactttgagtttctttatttcatatccaattgtcccttcccaattcctagattttcccaccccgactgcagtgtgtcaaaggcaagggcagccaccccacctgtggttggtgtcatgggtttggggtcagatagaacaggccttaaatcccacctctgcccttgtgacctacatggtctggggctgccattcaaggccatctgggtctcagtttcttcatttgttccagcaatggtccagtgcccctccagtgcgttcaccctcaccaggctctgaagcaagctcttatttatttatttctattttgagagggagtctcagtcactgaggttggagtgcagtggtgcgatctaggctcactgcaacctctgcctcccgggttcaaatgattctcctgcctcagcctcccaagtagctgggattacaggcacctgccaccacacctggctaatttttgtattttagtaaagatggggtttcgccatgttgcccaggctggtctcaatcccctgacctcaggtgattcactcacctgggcctcccaaagtgctgggattacagatgtaagccaccgcacctggccactcttatttatttatacagacagggtctcaccatgtggtcccagttgggcttaacctcctggtctcaagcaaatctccctcctcagcctcctgactggctgggaccgcagtgtgacccactacacccagctgatgcaagcccttaacaaaaggccctgccattctctccctgggcatcctcatgctgtttcgtcacctctgggactctttctaagcacccctgacctgcatcctcattgtccaaaatttctttgctgtcgattctttcctttgctcctgttctcgggtcctttgaatttgacctttggactctcccctttgacctacattctgcaaatctggccacatggtgcattggagcccgggacctactcctgaagcccaggctgagggcaagctctgggttcctatgtgtctggtaaggaaagtgggaaatgggaacagcaggttctaccttccaggagtgttgagagttacaggaaagaattgagtagagtccttgatcccaaagtattctctctgtatatgaattacctccctttcttcctcccttcctctttctttcctgtcttctttttttctctcttctccgtaattgttaagccattcttttttttttttttttttttttttgagatggagtctcgctctgtcacccaggctagagtgcagtggcacggtctcggctcactgcactctgcctccccggttcacgccattctcctgcctcagcctcccgagtagctgggactacaggcgcccgccaccacacccggctaatttttgtatttttagtagagacggggtttcatcgtgttagccaggatggtcttgatctcctgaccttgtgatccgcccacctcggcctcccaaagcgctgggattacaggtgtgagccaccgcgcctggcttgttaagccattctataaagcacaatgaccttcttaataaattattaaagcataactagccactcttttcctagtaaaacccaacagcagatgtgcctgctgttgaccaggtgaccgagtgacctcagccgcctatgcaagctgtggtggcaagtgttcagtaataacataatagaacaatctgtaagggtggcagccgtaccacccagatgcagtggctcatgcctgtaatcccagcactttgggaggccaatgtgggtggatcacttgaggtcaggagttcaagaccagcccagccaatatgcgaaaccctgtctctactgaaaatacaaaaattagctggggtggtgcgtgcctataatcccagctacttgggaggctgaggcaggagaatcgtgtgaacctgggaggcagaggttttagtgagctgagattgcaccattgcactccagcctgggcaacagagtgagactctatctcaggaaaaaaaaaatatatatatatatatatatggtgaagcacgatgctggcatctgtctgtgagttaatgtgtgcagtggaagaatctggaatgccaggaaacaaaagggatgatgggttatgaggaaggagcagggcgctttgactgacaggtgtgggtaatcacctgacacacaattaactgaattcaagatcaaagtcacctgcagaatatcaatgggctaagctgctctgccttccacagaagcagaacaggatcagaaaactccctctctaagcattccgtacctgggttagcaagagtgtcacgaatgtccaaacttgctagattatcaatctcacaggccatcagctgacccaaaggacatggggtcaggagaaagttctgcataagattctctacaagtgtcagagaaagagctctgggaaatgggattttggggccattttcactcccatcacaaacgaagtagaagcagcttcatccccactgagactgtagctggcctctcagagcctcaggaaaaccttggagtgtgaggggaggagggggagcttcatgacgagagagctgaaactccataatcaacacggtgtcaactggaactttctccttagcctctggatttcacatttcccttaggagaatctaatgtctacctctttatttggcagtcttatatggaatttatgtagaatgttgctttgaatcttctcaactaattcccattctgatttttttcaacttaaaaatttttatttttattttttgagacaggttttcactctcttgctcaagcttgagtgtagtggtgcaatcatagctcactgcaaccacaacctcctaggctcaagcaattctcccacctcagcctcccaagtagctgggactacaggcacataccaccatgcccagctaatttttttgcttttgctttgtgtatgtatgtgtggttttgttttgttttgttttgttttgttttgttttgttttgtagagacagggtctcactatgttgcccaggctggtcttgatctcttgggtttaagtaactcccacctcagcctcccaaattgctgggattacaggtgtgagtcactgcacctgaccccattctgattttttaaaaatttatgaataaataacctatttagacattttgaatcagaggtacgtggacccaactaatcatgtggttactatcaggaagccaggaccaggaatagtggttagaagaagaaccaagtcatccattcatccatccatccatccatccagtaacgaatatgtatgatatttttcctatatggggacacagtctagaaggagcttggagaccagttggggagcctgataacattaagtgtcaaaatgttactacaaaatgtcctgagttacaatgatagagaaagtcaaggagtcctgggagcaggcaggacaggcacatcccactgtggtggagggcaagtaggcacctgtgtagcttcctgaaaatggctcttggatggtggatggagtcttacaagataagcaagccgggtgcctctaaagcaaagtgcatggcaagaggtttggatgaggcagggcctggggaggaagagctggccactccttcctgttggagcagaaaggggaggcctcgagtggtgggaagtgagggcggagggagaggccagctcacagaacatcagcttcactgacaggcttcaatttcattttgcaaacaatttagaagccattaaaagtttttttttaggccaggcgtggtggctcacgcctataatcccagcactttgggagtctgaggcaggcagatcacctgaggtccggagttcgagaccagcctggccaacgtggtgaaaccctgcctctactaagaatacaaaaattagccaggcgtggtggcgcatgcctataatcccagctactcaggaggctgaggcaggagaattgtttgaacccaggagacggaggttgcagtgagccaagatcacaccactgcactccagcctgggtgacacactggactcgatctcaaaaaaaaaaaaaaaattttttttatattaactacagaaaaaagatctatttgttgtaaaaaaaaaagttagaaaatacagacaaaaagaagaaaataacaatgttcatatatctacattttttccttataaaatatgggttcaaataacatatactcttaaaatttgtatcatgttccttttatggatgtaatgtaatttatttaaccatatctttactgttggggatttaggatgtttctagtttcttgctattataaccaattatgtgaccattcttgcacataattatttctttaggatacactcttagaaatgtctcggcccaggggtagtatattcgataggatttgggtgcaatttattctcctatcagcctggtatggaaatatccttcagcatatcccatggccaacattgggaatggtgcctttaaaaaaatgatttaaacttctgccaattacaaataaatagttctcattgcttttaaataaataccattaattctggccgggttctgtggctcacgtctgtaatcctggcactttgagaggccaaggcaggcagatcacttgaggccaggagtttgagaccagcctggacaacatggtgaaaccccgtctctactaaaaatacaaaaagttagccaggcatggtggtgcatgcctgtaatcccagctactcgtgaggctgaggcaggagaatcgcttgagcccaggaggcggaggttgcagtgagccaagatcatgccgctgcactccagcctgggtgacagagcgagactccatctcaaaaacaaacaatcaacaataacaacaaaaagaataacattaattcagaaaagtgtgtatcgttccatatccagatgatgtctcttaacacacacacaaaaagaaaagtaaaaattatttaattagccaggcgcggtggcaagctcccataatcccagctactggggaggctgaggcaggagaattgcttgcacctgggaggcagaggttgcagtgagccgagatcgcgccattgcactccaacctgggtgacagagcaagactccatctcaggacaaaaaaaaaaaaaaattttaaacccatgtgcaatggacagaaaattaaaacagtacaggaagttataaaattaacaaaaaagtctccttcctcctaccctacccctagtaccattccacaaaagtgactactgttagccatttcttacacagctttcagaaaacttattattatttcaaaattattttcaaaagggctaatccaggcgcagtggttcacatttgtaatcccagcactttgggaggccgaggcaggcggatcacctgaggtcaggagttcaagaccagcctggccaacttggtgaaaccctgtctctactaaaaatacaaaattagccaagtgtggtgacacacacctgtaatcccagctacttgggaggctgaggaaggagaatcgcttgagctcaggaggcagaggttgcagcgagtcaagatcgcgccactgcactccagcatgggcgacacagcaagactccatctccaaaaaaagtggggggaggggctcataattcttcatacctcacttttgcatatgtcctagagaccttgttatacaagtacacacaaatctacctcattcttttatatgtgattccacagttttaattcattccgttatttactcatttacttgatgacttttattgaatacctactatataccatggagctatacagcagagacatagcagtgaagaagataaatgaggccccttctgtctggtccttgtatcttagtgggcagtagacagaacaaacaaaacaaaagcaagcttcgttcagatcatcacagaactgctgtgtgaagatctgaattgtgtacagctgagagtgatgagaggcaggaagggctgcttgcatagggaggtcatggagggacttcctgacatttgagctgagacttgagaaggagccagccacacaataatatagagtgagagcattcctggcagaggaaacagctcaggcaaaggctctaagggggaacaaggctagtgtgtcccaggcttagggtgccggccagatgagtacagagtagacaatgtggggagcttggtgggaggcagacgcagaaaggcagaggcaggcagtggtcagatcagggaagggttaatacgcaaatgtgtggattttgtcctaagtggaaactctgaaaaatttcaagcaagggagtcacacaatggcaccttggaatggggtggtggatgtggccattggagaaggtggacaagctcagaatgcattctggccgtagagccaacccaacaggctgaaggattggatgtgggagggagtgaaaagaaaggaataaaaattgcaggtgacttctacggttttcacttgagcaattgggagggcagtaaaggtgggtccctttacggaaatggaaagactaagagagcagcagttttggggtggaattggggagaggaaacagggactctgttgggcgtacagatgctcaaataaagatgacaagccccctattggctgtatgagtcaggcgctgggggagggactggagctgtaggtgcacaatgcatgccgatgtatctgtgtgtcatacaaggccccatgtatgactgcgtgtgtatacacatgcacagatgcacacattgttatgtcatcccagaccatgtttttgtatttttgtacctgtatcttggtatatatctgagtatatcttttttttttttttttttttttttttttgagacagagtcttgctctgttgcccaggctggagtgcagtggtgtgatcttggctcactgcaacctctgtctcccgggttcaagcgattcttctgcctcagcctcccaagtagctgggactacaggcgtgcaccaccacacccagctaatttttgtatttttagtagagatggggtttcaccgtgttggccaggctggtctcgatctcctgacctcgtgatctgcccacttcagcctcccaaagtgctgggattacaggcgtgagccaccacgcctggcctatctgagtatatctttaggagaaatttccaatagtggagcattagtcaaaaggtccatgaattgacttttttttaatagatcttgacaaattttccttcaaaaagctcttgcccactgtcatgccaagcgtcaggttccagcccatgttgaggtctgaggggagtgggtggatgggtggcgaatagcggaaggaatatttagggggctgtaggcaggtaaaatatggttttattcagcagctttttcatcagcagttttttttatatactttaagttctagggtacatgtgtacaatgtgcaggtttgttacataggtatatatgtgccatgttggtttgctgcacccatcagctcgtcatttacactaggtatttctcctaatgctatccctcccccagccccccaccccttgacaggccccggtgtgtgatgttccccaccctgtgtccaagtgttctcattgttcgattcctacctatgagtgagaacattcggtgtttggttttctgtccttgtgatagtttcatcagaagctttctcatacaattcacctttatctcggctgcctgctccagctttgcggctcttgccattcccaggcttacagctgcattccctggcctacaagcctggctctcccttatggggtcagcagttttactctctgcctctgggcacaagccatgccgaaccacatgtacagcgtcagcagggcagttataccttttacagacaatagtggctctgagccacttacacaaacagattacataacaagtggagttatgcgcctgcgcgccagactccctgagtcacgctggccctgatgtttgcctctgcctgttttgtttttgtttttgtttttgttttttgagacggagtttcgctctgtcgcccaggctggagtgcaatggtgcaatctcggcttactgtaacctccgcctcccaggttcaagcgattctcctgcctcagcctcccgagccaccacacccagctattttttttttttttttgtatttatagtagagatggggtttcaccatgttggccaggctggtctcaaacacctgacctctggtgatccacccgcctcagcctcccaaagtgttaggattgcaggcgtgagccaccgcacctggctaacctattcttgaccaaagcacatccatgtaccttacacccacttaccttcccatcaagaacactcaacgatgtccctttccctacactctcgccagtattggatattttcacactctattttcttttcaatctgatagaagaaaataatatcttataattttcagaatttgcattcctttatttgccattttagtttttttcctgtgaactatccatttgcccattttgccattgagcttttaatctatcttactgagttcctccgagtgctttgtaaattaagaaaataagctctctgtcaaattgcctgcaacatttccttcatagcttgtcattttttaaaaaactttcaaaggtgttttcacccagtgatgtttcatcttttttctgaggtcagatttctcaatcatttgctttataaagtttgagttttccttaggatgctccatttcaagagtctaataaattcacccattattctaaaacttttgtaaatttcattttatattttcagtttattctaaaacttgcagttttcagtttattctaaaacttttaaatagtctaagactttagaaagatttcagtttattctaaaacttgtgtagtttcttcgtatttaaatctttgatccatttgaaactattttggcttacagagtgcggtatgaacagaacttgagtttgtataagacttagccagctgtctctacatcactgattgagtaacccctcgtgtcccatgcatagtcctaggcgccactgtgctggatcagaagcgaagggagaaggttaagtgactcactcagtatttgaccacaacactgcttagctcaaaagtccaccttgctgcccccttttagttaaaatgagcctgttagtgagacccttgatttttttagctttttttatttttagtttttctgggtcatagtaggtgtatatatttatgaggtgcctcgggagcattctggaccatcacagacgctttgggtaactcttacattggagggtaagcccatccccttcttaatcaatacggaggctacccactccacattaccttcttttcgagggcctgtttcccttgcctccataactgttgtggctattgacgaccaggcttctaaacctcttaaagctccccaactctggtgccaacttggacaacattcttttatgcactcctttttagttatccccacctgcccagttcccttattaggtgaggcattttaactaaattgtctgcttccctgactattcctgggctatagccacacctcattgctgcccttttccccagtttaaatcctccttcgcatcatccccttgtgtctccctaccttaatccacaagtataggacacctctactccctccttggtgaccgatcatgcaccccttaccattccattaaaacctaatcacccttaccccgctcaacaccagtatcccatcccacagcacactttaaaaggattaaagcctgttatcactggcctgctacagcatggccttctaaagcctataaactctccttgcaattcctccattttacctgtccaaaacccggaaaagtcttacaggttagttcaggatctgcaccttatcaaccaaattgtcttgcctatccacaccgtgatgccaaacccatatactctcctatcctcaatacctccctccacaacccattattctgttctagataaatgtagctgaccccatagatcctaaatcctttccccactcctctttccattccttaaaaaactcatcccaacccttttcattacacacagctgaagtacaggactgtgtggtcggaattcttacacaagagctggaaccacgccctgtagtctttctgtccaaacaacttgaccttactgttttagcctagccctcatgtctgcgtgcagcggctgccactgctttaatattttagaggccctcaaaatcacaaactatgctcaactcactccgtacagttctcataacttccaaaatctattttcttcctcccacctgatgcatatactttctgccctccggctcctttggctatactcactctttgttgagtctcccacagttaccattgttcctggcccagacttcaatccagcctcccacattattctggataccacacctgacccccatgactctatctctctgatccacctgacatttattccatttccccatctttccttctttcctattcctcaccctgatcacacttggtttattgatggcagttccaccaggcctaatcaccactcatcagcaaaggcaggctatgctatagtatcttccacatctatcattgaggctactgctctgccctgctccactccctctcagcaaggcgaactcattgccttaactcaggccctcactcttgcaaagggactacgcgtcaatatttatactgactctaaatatgccttccatatcctgcaccaccatgctgttacatgggcagaaagaaatttcctcactacacaagagtcctccattattaatgtgtccttaataaaacctcttcttaaagctgctttactttcaaaggaagctggagtcattcgctgcaagggccatcaaaaggcatcagatcccattgctcagggcaactcttatgctgataaggtagctaaagaggcagctagttttccaacttctgtccctgatggccagtttttctcctcattggtcactcctatttactgtcccactgaagtttccacctatcaatccctctccactcaaggcagatggtttttagacaaaaaaaaaatctccttcaagcctcactagcccattctattcctgtcgtcatttcataacctcttccatgtaggttacaagccattagcccgcctcttaaaaactctcatttcctttccattgtgaaaatctatccccaatccaccactcttgactccctcttggagtgggtagatgatctttgctgacaggacacactccaatactctcacccttatgaagtcctgttctttacttttatactcactcttattcttgttcccgttcttatgccaccctctctacctcttcgcagctatctccaccacactatcaatctcactcactctctcctagctgtttctaatccttctttaacaaacaattgctggctttacatttctctttcctccaaaatcaatgaggccccgacttactcactgctaaaaaaagggggactctgtatatttttaaatgaacagtgttgtttttacctaaatcagtctggcctggtatatgacaacataaaaaaactcaaggatagagcccaaaaactcactaaccaagcaaataattgcgttgatcccccttggacactgtctaattggatgtcctgggtactcccaattcttagttctttaatacctatttttctccttcttttattcggaccttgtgtcttccatttagcttctcaattcatacaaaacacatacagtccatcaccaatcattctgtgcaacaaatcctacttctaacaaccccacaatatcaccccttaccccaaaatctttcttcagtttaatctctcccactctaggttcccatgctgcccctaatcccactctaagcatccctgagaaacatcgcccattatctctccatactaccccccaaaattttcgccaccccaacacttcaccactattttgttttgtttttcttattaatataagaagacaggaatgtcaggcctctgagcccaagctaagccatcatgtcccctgtgacctgcacatatacatccagatggcctgaagcaactgaagatccacaaaagaagtgaaaatagccttaactgatgacattccaccattgtgatttgttcctgccccaccctaactgatacgctatattctcccctgcccttaagaaggtactttgtaatattctccccgcccttgagaatgtactttttatgcctatcccaaacctgtaagaactaatgataatcccaccaccctttgctgactcattttttggactcagcctgcctgcatccagatgaaataaacaaccttgttgctcacacaaagcctgtttggtggtctcttcacatggacgtgtgtgacaatctcattgagttttgagttgcatttctctgatgatcaatgatgttgagcacgttttcatatacctgtttgccttttgtagatcttctttgaaagatgtctatcagatcttttgcccattttttaattagattattatattttttcctactgtgttatttgggctccttacatattctggttattaatcccttgtcaaatgggtgtttgcaaatattttctcccattctgtggattgttgcttcattttggtgattgtttcttttgctgtacagaagctttttaacttgatgtgatcccatttgcccatttttgcttaggttgcctgtgcttgtggagtattactcaagaaatattttccaagtccaatgttctggagaatttcctcagtattttcttttagtagtttcacagtttgagatcttagatttaagtatttaatccccacccccttttttttgtgagacaaggtctggctttatcgccctgtctgcagtacagtaccatgatctcagttcactgcaacctctatctcccaggctcaagccatcctcccacctcagtctccccagttcctgggactacaggcacatacaccatgcccagctgttttttggggttttttttgtttgtttgttttagatggggttttgccatgttgtccaggctggccttgaactcatgagttcaggtgatctgcctgccttggcctcctaaagtgttgggattacaggcatgagccaccacacccggcctctttaatccattttgtatatggtgaaaaacagaagggtctggtttcattcttctgcatatggatataccattttcccagcatgatttactgaggagactgtcctttccccagtgaatgttcttggcacttttgtcaaaaatgagcttagtgtagatatgtagatttattcttgggttcttcattctgttccattgttctatgtgtgttttcatgccagtaccatgctgttgtggttaccatatctctgtagtataatttgaagtcaggtaatgtgatttctccagttttgttctttttgctctggttgacttttgctattctgggtattttgtggttccatataaacattagaattatttattctatttctgtgaaaaatgtctaatatttttataggaattgcattgaatctgtagattactttgggtagtatggacattttagcgatgttggttctttcaatgcattaacatggaatatctttccatttttttgtatcctcttcaatttcttgcatcagtgctttagagttttcattgtagagatcgttcacttcttcacatttattcctaggtattttattttatttatagctattgtaaatgagattactttcttgatttctttttcaggttgttcattgttggcatacagaaatgcaaatgatttttgtgtgttgattttgtgtcctgcaactttactgaatgtgttgatcagttctaatagctttttggtggagttttaggtttttccaaatataagatcatatctgcaaacaaggataatttgacgtcttcctttccaattcagatgcctttatttatttatcttgtccaattgctctagctaggacttccagtactatgttgaataacagtggtaaaagtgagcatccttgtcttgttccagatcttagagtaaaggatttcaatttttgcccattctgtatgatactaactgtgggtctgtcatatatggcttttattatgttgaggtatcttccttctatacccagttttttgagggtttttctaaatcatgaagggatgtggaattttatcaaatacctcttcagcatcaatggaaatgattgtgtggcttttgtccttcactctgttgatatgatgtatcacactgatttgcatatgctgaatcatacttgcatccttgggataaatcccacttggttatgataaatgatgttttcaatgtgttgttgaatttgttttgctaacattttgctgagaatttttgcatcagtattcatcacagatgttggcctgtacttttggttttttttttttttttttttttttttgatatgactttgtctggtttgggtgtcagggtaatactggccttgttgaatgagtttggaagtattccctcatcctctattttccagaatagtttgagtaggattggtattagttctttaaatgtttggtaaaattcaacagggaagccattgagtcccaggcttttctttgctcagagactttttgtcatggcatcctgttacttgttactggtctattaaggttttggatttcttcatggttcaatcttggtagattgtatgtgtttaggaatgtatccacttctaggttttccaatttattggcatatagctgctcatagtagcctctaatgatccttttaatttgttgatatcaattgtaatgtctcctttttcatctctgactttatttatttgggtcttctctatttttttcttttttagtcaggctaaagacttgccaattttgtttatcttttcaacaaaatgacttttagtttcattgatcttttgtatttccttcatttccatttcatttattttagtttcattgatcttttgcatttgcattttcttcatttcaatttcatttatttctgccctgatctttattatttctttatttctactaattttgggtttgcttcactcttgcatttctagttctttaagatgcatcattaggttgtttatttgaggtttttctactttttttgatgtagatactcaatactgctttcactgtatcccatagattttattgtgttgtgtttccattttcatttgtttcaagaaatttttaaatttccttcttactttttttcattaacccactagttattcaggggcatattgtttaatttccatgttttgtatagttttcaaaattcttcttgttattgatttctagttttattctttgtggtcactgaagacacttgatatgatttcaattattttgaatatttcaagacctgttttgtggcctaacatatggtctatccttgagaatgatccatgtgctgaggagaagactgtgtatctgcagctgctgaatgaaatgttcttttaaatatctattaggtccatttggtctatagtacagattaagtccaacgtttctttgttgattttctgtctggatgcactgtccaatgctgaaagtgtagtgtagaagtctccagcaattattgtattgaggatatattattttagctataaagatatttgcaatatatatctgagtgctccactgttgggtgcatatatacttacaattgctatatcctcttgttgaattgatttctttattattatataatgttcttctttgtctctttttatagttttgtcttaaaatctatgtaatgtgatataagtatagctattcatactcttttttggtttccatttgcatgaaatatctttttcgattcctttaattcacctatttatgtctttataggtgaagtgtgtttcttgtaggcaacagatcttgggtctagtttttctttttaatccattcagctgctccatgtcttttgactgaagtgtttagtccatttacattcaatgttattattgataactaaagactactcctgcccttttgttacttgtttactggttgttttctggccttctcttccttccttctttcttttcttcttgtcttctttttactgaagctgattttgtctggtgatatgtattaatttcttactttttattttttgtgtatctgttgtatgtgtatgtttttgagttgatattaccatgaggcttggaaataatatcttataactcattattttaagctgatgacaacttaacactgattgtaataacaagctaacaaacaagcaaatataaggctaatagaaaaaaactctacacttgaacttcatccccccactttttaattttttgttgtttctattgataccttattatactctcaatgtcttaaatgttgctttaggctgggtgcggtggctcacaccagtaatctcagcacttttggaagccaaggtgggcagatcactggagcccaagagttcaagaccagcctgggcaacatggcaaaaacttgtccctcctaaaaatacaaaaaatagccgggtgtagtggtgtgcacctgtagtcccagctactcaggaggctgaggtgggaggatcacttgagccagggaggcagaagttgcagtgagccaaggtcatgtcactacactccaggcctggacaacaaagtaagaccccatctcaaaaaaaaaaagcatagttattattttttatatattttataggttcttcttttagtctttctactcaagatataagtgatttacacacaatttcaggggttagaatctgtttttctgtgtacttactattaatagtgagatttgtaccttcagatgatttcttactgctcattaacatccttttctttaagattgaagaactccctttagcctttagcacttctttctttttttatttttatttatttatttgttttaagatggagagtctcactctgtcacccaggctggagtgcatggcacaatctcagctcactgcaaactctgcctcccgggttcaagtgattctcgagcctcagcctcccaagtagctgggattacagtcatgcaccaccatgccctgctaattgttgtatttttagtggagacaggtttcaccatgttgtccaggttggtctcaaactcctgacctcaagtccctttagcatttcttataggacaggtctagtgttgataaaattgctcaacttttgtttgtctgagaaagtatttctccttcatgtttgaagggtattttcactagatatactattctacgataaaagttttttccttcaacacttaaataccactctctcccagcctgtaagatttccctcaagaagcctactgccagaagttttggagctcccttttatgttacttatttctcttctctttctgtttttaggacccttttttttatccttgacttttgggagtttttttattaagtgtcttgagatagtcttatttgggttaaatctgcttggtttctggaaccttctggtatttgaacactgatatctttatctaggtttgggaagttctctgtaattatcccgttgataaaactttctatcctgatctgtctctaccttctcttaaggccagtaacgcttagatttgcccttttgagactattttctagatcttataggcatgtttcattctttctcattctttttcttttgtctcctctgactctgtattttcaaataacctgtcttcaagctcagtaattctttctttggcttggtcaattctgctgttaggagattctgatgcattctttggtgtgtctatttcatttttcagctctggaatttctgcttaattcttttttattattttgatctcttcattaaatttatgtgataggattctgaattccttctctgagttatcttggatttcactgagcttcctcaaaacagctattttgaattctctgtctgaaaggtccctgtttctccaggattggtccctggtgccttatttggttgtttgctgaggacatgttttcctgaattgtctgactggccctgtggcctgagtcacatttcagctgaagtcccaggctgctgccaacacctccatggcctggcagtcttccactggagttcaagttacactgctcaccagagaatcacacgcattcagtgtgtggactccatcctcacaatcagatgctcagtgtccaaaatgctgggtaagaaacatcctgaagaacacaaatctgagatacagcctcttccaggcctgctccaaggctccagaccaatgcatgaagcacagcctgagtccacgtgcctgagggaacagacctccaaagcctacattgggagcttccacctggcaaggaaggtgtgctaagggcagagcttccggcctccctgttatctcaaatgtggacctatcactggggccctagtactgggcccaatacttgcctccaccctttgtcaatgcgaacatccttcctcctggggacagagatttagaggttgactttagaaaaagccactctctatagatattttgaagcagcaagtccccccagcttcaaattttgtgctggctgaggcagcccagcctggttggtgactagaatggcctgaactgggagtcatggaaactgactcagagtcatggaaagttggggctgaaaggggaagaagaggtcatgcaccatccgtcttgcagctataaaaactaaggtttaggttggtgagggggtgtacccgaaggatgactcaaagggtacttcacgggtaaaggaactcagctcaaataaggtgactcaagtctatttacagccttgtccagtgtggactcaagaatagcctggcctaccaccctgagctgtcagggaggacagatgagatggacattgtgaaaatggggtactgccagcctttaaaatgcggcgagtgcacaagtcacgcagtgctgttatcaactcatgatataagttcctcttccctcccccgactgcctgtgttgagtctcaaattcatcccactgcagggaggtcagaaaaagttcagaacttctttctgacctccctcttgtgggatttaatgaggacatgaagtggtgacattgaggtgggagttaaggagaatgtgctgggcttggggcccagcagatggacatatgttacctgtgcccctggggatgattctaccttctaaaatgggccatggaaacctggtttcatgtggttgggtcaatccccccagtgcttctgaggttgatgagttaaacgatgcaaaggccatggttgggagatctcctcttgggatacgactttggtgaatttacctgggtctggtcctcattcctgcaaatctagaacccgaccaccatccagacaagaagagagactgagaccctacaataactcaagtgatttattttggggacactcctttccaggaagctgaatgcttgtgaccctcatctgtttttctgatttcagctgcctgggaggttgcctgagcaggcaggaggcagctcatgggcatggacttgaactgatgcctcgaatggcctgcctggcctttgtctttctttatgttccattaccaaatattctgctcctggaatcacagcctttgtttttatttatttatttatttatttatttatttattattttaaatgttttatagagatggggggtcttgccagtacaggctggtctcaaattcctgggctcaagcaaacatcctgcctcagcctcccaaaatgctgggattacacaacaatgccctaaaataagactttcaggtgaagcttatgcatgtctttcctgcttggtgagtagggtatgattagagttggatttttccatcccatattcactctacagaatcaatttagtgttctgcttatctatgggacattgatgtcatgtgatgggtgatgtcatgtgatgggtgatgtcatgtgatgggtgatgtcatgtgatgtgtgatgtcatgtgatgggtgatgtcatgtgatgcatgatgtcatgtgatgggtgatgtcatgtgatgggtgatgccatgtgatgggttatgtcatgtgatgggtgatgccatgtgacaggtggtcatgtgacaaggtgatcctgtgatgagtggtcatgtgatgggtgatgtcatgtgatgggtgatgggatgggcgatgtcatgtgatgggtgatcatgtgacaggtgatgtcatgtgatgggtggtcatgtgatgggtgatatgtaatgggtgatgtcatgtgggggtggtcatgtgataggtgatgtcatgtgatcgacgatcatgtgatgggtgatgtcatgtgatgggtgatgtcatgtgatgggtgatcatgtgacaagtgatcatgtgatgggtgatgtcatatcatgggtgatgtcatgtgacaggtgatcatgtgacaggtgatcatgtgatgggtgatgtcatgtgatgggtgatgccatgtgacatgtggtcatgtgacaggtgatgtcatgtgatgggtgatcatgtgatgagtgatgtcatgtgatgggtgatgtcatgtgataggtgatcatgtgatgagtgatgtcatgtgacagggatgtcatgtgatgggtgatcatgtgatgggtgctgtcatgtaatgggtggtcatgtgatgggtgatgtcatgtgatgggtgatgtgatgggcaatcatgtgatgggtgatgtgatggtgatcatgtgacaggtgatgtcatgtgatgggtggtcatgtgatgggtgatatcatgtaatgggtgatgtcatgcgggggtggtcatgtgataggtgatgtcatgtgatgggtgatcatgtgatgggtgatgtcacgtgatgggtgatatcacatgatgggcgacatcacgtgatgggcgatcatatgatgggtgatgtcatgtgatgggcaatatcacgtgatgggcgacatcacgtgatgggcaatcatgtgatgggtgatgtcacatcatgggtgatcatgtgatgggtgattgatgtcatatgattccagggggagcacctgttcaccaagcaggggagaggctgtgagttctctgccacgctggtaacacaatctctactggggcttcctagtgctgactgctgcaggtggctcatcatagcacaccaagggccaccacagggacacattaccaaaggaaaccccagaagacacaaaacatccccttcttcctccataaacttgggagccagatgttgggtgacatcgttcaccatctctggctgctctggccttgctggaaccccctgttttctctttctcctcttgcatcatgataaatggccgatcattaatggatgaaaagtggtgtctctgacacaaaggctcaacgaggcgtctctgtcaaagggtcacactagattctatatccacacacaggagacctctggactggggaccctgagcagtgccttggagaattctgcagcttcctgctctcaggcctgtggccccatctctccttgattgatgcccccaaggatgccctgaggttagaacactccctccgtgggtgtgttcttgaggccacccaaagtggggagctgtgtctgagactccacttacggccagaatactcaaaggcgttatctcccaggtaaaatggtggaccagaaactacctgcttgtgagtaagtaaggaaggagagccaaggtaaagccattagcatttgcagaccagttgttccctgacaaacatagatttagaacagaaattggcagctaaataaagtttagtacttgtattactcagggttctctagagggacagaactaataggagatatatatatatatatgaaggggagtttattaggaaaatgaactcacacaatcacaaggtaaagtcccacaataggctgtttgcaagctgaggagccaggaagccagtccaagtaccaaaacctcaaaggtacggaagctgacagagcaaccttcagtctgtagctgaaagcccaagagcccctggcaaatcactggtgtaagtccaagagtccagaagctgaagaacttggagtccgatgttcaagggcaggaagcatttaccatgggagaaaggtggaggctggaagacttagccaatctagtctttcatgttcttctgcctacttttattctggccacactggcagctgattggatggtgcccacccggattgagggtgggtctgcctttcccattccactgactcaaacgttaatctcctttgacaataccctcacagacacacccaggaacaatactttgcatccttcaatctgatcaagttgacattcagtattaaccatcaaagtactttttttttttttggccagtggtacagttgcctgggttagtactgagacaaaaggatgatggtgggggatgctggcttgcacaggacttcagctgtgaggagcctgtgtcctcgcggaggcttctgtttgcagaaagaaagttgccatggccctggaggagatggagctgagaagctgaggagggggagaaagggtcaagttcctgatgctgcagcccacagagacccctccaacctgcctcaggagagggtgtgagggcaggagcttgttgtgttcacaaagatggaggcacagtggtctagaaagacccaggaggaggctcagaatggagcggggtccagcaagacttctgcaacaggcgtttttgtctcctcctacccaactccactccaggatggagccatcaccaggtctggccatccacccttccaaatgtgaatcaggggaggatagtcccagctggaagctggtcccaatcaccttgtcagtaattaagctaggggtggtcaccagagtctgaagcagccaatgagacattgaggggatgtgatgggggtggggactctgggaaacttctgggatcagtggtctggttttcttcctcagaagtccttgtgtctggtgtctgggctgatctctctctgctgcctacttcagagatctctctctgctgccttaggatgaagacagttctgaggccatgaccacagagcaagaaggaacttgtatcaaccaattccaaggacaccaccaaggccaaacaaacaaaccaaaagccccaaatcagcaattaacagtgaaacaagagaggaagcagtggctgccatgatcagtggctgaccttacagagaggctagtatttaggggatgaactgcagggcttgggggagcaataggcttagaccacccaaaatgggcgctgtgtctgagactccacttaacgatcagaatactcaaaggcactacctcccagataaaatcttggactagaaactacctacttgcgagtaagggaaatgattttttaaaaaaatagtaataattgaaaaactggaaattcatatgcaaaagaatgacactggagccttccctaataacatagacaaaaattaactcaaatggatcaaagacctaaatgtaggatctaaaaccataaaactcttagaagaaaacacaaggcaaaagtttcacagcattggatttgccagtgatttcatagacatgatgctgaggggacaggcaacaacaacaacaacacagacaaatggaacttcatgaaaatttaaattatgtgtttttgactcatatctttttttttttaagagatgggggttttgctatgctgcccaggctgaaatgcagtggctatttactggcatgatcatggcgcaccacagcctcaaactcctgagtccaagtgatcctctcacctctgcctcctgagtagccaggattacaggtgcaaaccaccatgtctggctaaaatttcaaaatttgtgcaccaaatgacaatatcaacagagtaaaaaggcaactcacacaatgggataaaatatttgcaaattacatatctgataaggaattatatcccaaatatagacagaactcctaaaacaataaaaaaaaaaaaggcccgattaaatgggcaaaggacttgacatttctccagaagaaatctacaaatagccaataaatacatgaaaagatgctcaacaccactcattatcaggaaaatgcaaatcaaaaccacaatgggatatcacttcacacctgttagaatagccattgtgtgtgtgtatatatgtgtgtataaaaacatgtataaaacaacagaaacaacaaatgctggtgagaatgtgtatatatatatgtatagaaacaacatgtataaaacaacagaaaacaacaaatgctggtgagaatgtggagacactagaacccttgtgcactattggtggggaggtaaaatggtgtagctgctattatgggaaatagtattgaggttactcaaaaaattaaaaatagaactatcatatgatccagaagtcccacttctgggtatttatccagaaaaactgaaaacaggattgcaaagtgctatctgcatgcctatgttcattggaagcagcattattcacaataaccaagagatggaaacagcctaaacgtccatcaatggatgaatggataaagaaagtgtgatatgtacatacaatgtgatgcggtttggctctgtgtccccacccaaatctcatcgtgtagctcccataattcccacatgttgtaggagggacctggtgggagatgactgaatcatgagggcagggcttccccgtgctgttctggtggtagtgaatgggtctcatgagatctgatggttttataaacgggagtctccctgcagaagctctctctctttgcctgctgccatccatgtaagatgtgacttgctcctccttgccttccaccatgattgtaaggcctccccagccatgtggaactgtaagtccaataaacctctttcttttgtaaattgcccagtcttgggtatgtgtttatcggcagtgtgaaaacaggctaatacacaatggaataatattttagtgggggatgagaacaaaatattttatagtgtgcttgaaagtaggctgagaacacagttttttcttctatttattttcttttaaaaattattactatttttaattgacacataatcagacatttatggggcacattgtgatattttgatacatgtatataatgtgtaatgatcaaataagggtaatcagcatatccatcacctcacttttgtgttggaaacattcaaaatctactcttctagctatttgaaaatatacaataagttgttgacaattatagacatcccctagtgctatagcacacgaggatttattctgcctatgcagctgtacttttgtatctgttaacaaatctctggctatcccctaacccccaacacactgccccacctctaataaccactgttctattctctatgtcttgagatcaacttgagaacatgcagtatttctctttctgggcctgacttatttcattcacataacgtcctccaagctcatccatgttgccacaaatgatagaattttgttcttttttttttttttaaacggtgtcttgctctgtcgccaggctgaagtgcagtggcaggatcttggctcactgcaacctccacctcctgggttcaagcgattctcctgcctcagcctcctgagtagctgggactacaggcacacactaacaggcccagctaatttttgcatttttagtagagacagggtttcaccatgttggccaggatggtcttgatctcttgatctcgtgatccgcctgcctcggcctcccaaagtgctgggattacaggcgtgagccaccgcgcccagtcgaattttgttctttcttacatctaaacagtattccattatgtatatgtgccacgtattctttatcttacaatggaatataattttattcagccttaacaaagaaggaaatcctgccgtattcaacaacatggatgcatcttgaggacattatgctaactaaaataagacagtcacaggttaaaggctgcatggttctggttacatgaggtaactaaactagtcacactcatagaagcaaaaagtaaaatagtggcagccgggggctggtggaggagtgggagggagagttgctactcaatgggcatgatttagtcatgcaaggtgagaaagttctagaactctgctgtacaacaatgtgcatataattaatcatattttaccacacacctaagagtttgttaagagggcagatttcatgttaggtgttttttgtttgttcattttttaccacaatttttaaaaaggggaagaagaaggaacccatgtctgcctctctggtgagggcccttcccgctgctatctctttactgcccctagccagctgccctcggctctgaacttcctctgtggctatgcagttgttcagaagtaaaggcctgtgggaagggcctcatggggaaggaaaagctgtgcttttttcttaaaagagcaagatccacacctgcccactaactttttttttttttttgagacagagtttcgctctgtcctctgtcacccaggctgaagtgcaatggcaccatctcgtctcactgcaacctccacttcccgggttcaagtgatcctcctgcctcagcctcctgagtagctgggactacaggtgtacaccaccacacccagctaattgctgtatttttagtagagacagcagttttgccatgttggccaggctggtcttgaactcctgacctcaggtgatccacctgcctcagcctcccaaaggtctgggattacaggcgggagccaccatgcccggcctcactaacttttggttccattaagtgtgaaaatcagcatatgccgaatcctcatggtctgtggctatttaagggcatgacggctttggctccaagctcccaatggaaacatatttgctggaaaatgcaatgccagcactagtgactcatttattgacttccgtctttctccctaccccagagaatgggcgtattaggcaagccttgcttgtcagcttgtgttggaaccccaaggggtattcctagagatgtgtacaaggggtggtggtgtaagggcgtgcgcggtgggtggtagttgggcagacagacaatagatgcctactttactccagtggattctccttaacagagccacgagaataacaacccagccacactagctccagagagattgacggattcattgaatatcaacaggaagaaacggtgggaaaagaatgacatcacgttgacaagcgcccatgtcccctcgcccctgagtccagctggtgaagcaccatgctttggctttccctcccgcggagcggtgccgtcctccctgggtctggtcggatcttcgggaagctggatccaggaaagcattccaggaggtagggccctggggctggtggactgtgggtcttggtccctcacagaatgactcaggggatcttagccgggctcgaactctcctctctggccattatggaattttcaggcccatcattggccagagacctaaattcagttcaaagtcagagaaagtttctctttggctgaaggacaagaagaggggaggctctgggtgccatgctagggaccagagggtcccctctcctttatccactgctgacagtcagtactccctattagaaccaagagcaggttggaggcgtcctcatgggtgttcaaagggcaacatgccgaacatgtgtggtgtgtttgcttgtgggcaggtgggggcgggagcacatctcacatgggaaggtccctttggtgtgagggtccctcaaccatacagcacaaagtgaccacattcaagggcctcatcgccgtgggtgaagcctgtgaggagacagaaccacttccctaggacagttttcattagtaacatgatttcaacatcaccgaaaagggagggtgccatttcctgcgatggttttcgttactgccctccccacctggaggtggttcttgaggcctgacaggctcttttggggaggagacccaagctgtcatgctgaggaggctcccaagctgcagcccctcggaggtgggggaataggcagggagcttggggagctaggaggaggaagaggtgggagggggaggacaagcaccgggccgggccagggaggttcccattgcctcctcagccctgtggactcagagccatgtcctccctggggacagggtccatccagcccctcatgccctagaaccaggaactcatcccagaatcaccctccttgtgtgtgggatcagagaggtttcctatgaacataagtcattaaaacccaactttgctagaaaaaaaaaaatttaaaaacacggatatatcaggttctcaggcaaagacggtgttgagttggtctccggaatgatggaagtctagggctgggggggtctcccccaacctctttctgtactttggtcccatgctctgtgcccgagttattccagcagtggggacagagtcgtccagtgcttgagctccatctctacagctcctgaccaagagaacaggtgctggcaccccaggaggtgatggtggctcaggagaggacctggctaagtccctgagctgtgcagaacagggaggtgcccaccagctccaaggccagggcggaggcccagggcccctatctcagtcactgcatcccgaggactcgtagatgttccttccacagcccgagtctcttctggaaacgtggccagggcaggaaggctctgcagatccatctctctaagtggccatgtctttagtcagaggttcggagaagttcatgtagataggctgttcccctggctcctcagggaccctctgagaccccttcaaccagaggatggcagtgaccaagatgagcaagatgggcaccttcacaaataccaggagcatgtagtggttcctggggaaggggatgcagtggtcagagccctgggcatccccaggccatgtcactcccatcccctgaccctgtgagccaccagccaaagcctgtgaccctgggccgggcagccccactctgaagattcctgtaaacctcctccttggttcaacctcaaggggtcctccaacagtcaccttggctggttttgcacggggcccatcttcctttctaacatcaccttctgggaccctctttgcccaaagtacatctcagctcaacagaagcgccagaggtcaccaaatacaggttgtgtttcctgcctctgttcctgctaatgctagctccaggctggtaaatcacccttcctgttctgtgtcccttgatgtcttgcaccacagagggtggtatcttatctccccctggcacccattaggccaccaatgcaaggttgactgattgactgggagaatgatgctcactgagaagagttctgcagagcggttttctggtgagagctagagtggggagatggtggattgcagtgatgggggcaggagagagatggagggtgggcttggggccttgactctggctagaacaggtgctggcatttggtgacaggcaggagttcccaggcttggcttccccttaggagggaccccaggtaggggcaggagaaagaaccacatgactcacctcttgtgggagccgatgaacactgccatattgctgttggtaggtgagcttgctgttgtggaagccgctccctctagacacaggcaaagtcagccatgggttattagcacagttgggagctcatgcatgggtcacaaagccacgcgaccctgccagccctcaccagaagacccttttccctggagtaggaggatttttctctcctgctacagcccctcatgcttctactgagtcacttcaatctcaacacacagacatttttcctcatcatgttcagatgtggcaagaaaaattaaaaattaaacaggagtaaacactgtagtttattctgggagagagaggttttttcatactttctttccacctatcctgcaagtgggactattggatggggaaataaatttctggtcttttccactggagtggtgcctgagcagggcttaaggagagaagattctggaaatgggctgtccagaaattggggtagtccagaaaaagggaaaggggactccagaaggctcatgaagaaaagggcacactccagttaactagagaacatcgactatgagaaacggaacatttttaggagcaaccatataggcaatttgttgggggcagtctggtcaggggggccctgagcccagcccagcactgagtatccatgacccaacagtgatcttttatttcagtcctcggccccagcaaatttttctcaaaggtcccaggctgtccaggcacggtggttcacgcctgtaatcccagcactttggaagaccaagggaggcagatcgcttgaggccaggagtttgaaaccagcctgggcaacatggtgaaatcccatctctacaaaaaatacaaaatgaaccaggcgtggtcatgtgcccctgtagtcccagctactcaggaagctgaagtggaaggattgattgagcccaggaggtcgaggctgcagtgagtcaagttcaccccactgcactccagcctgggctacagactgaaaccctgtctcaaaaaacaaacaaaacaaaataaaacaaaacaaaacaaaaaagtcccaggctttggccacactaggtgggctcctgtctgagctgcaggtaattccaatcacaacagttcctatggagcccctgatcgttttacaggctggtacccctgtagatcccccacccaagactccggaacatctctctccctaaagctccacactggccactgttttttgtctctttgtaccgcctgcatgtcttgctcaatcccctctctgcccccatagatattctgggtttcccctacttggcagccctggggaagtcttgcttgaccctttctggactcctctttactcagctgcagccactgtgtccatgtgcctctttggtcccaaccccaacagtacacaggcttgttctaaagccggcattgtctatttccacatcaccaccaaatggacccgagtggacactgagctgatgaagtactgagtaggggtgtgcgggtggaagtgggggttgggggctgcttcccagactccagcaacagcagcaggatgaccccagagtctatcagtagagtccaaggcatggaggagaagccagggcacccagagtggtccctgacgttgcccgtgatggaagccatccttttgctttaaagcgtccactgtcacccatgcacctccctggggctttcttaccccgtgctcatcttacacagccagataaagtagcggagcaggtggctggggacctagagaggagggtgttgtaagacacccagagctactctgggttggtgcagttagtgggactcaatactaggaccccctgggcagctctaggttccttctctgccatgtcatgagcagggctgggccaccagtcaccaaagctgaggtccccattcccacccccatcccaagccccacctggattccttggagagacctcagggactgagatagcagagcgatgctggccaccactctcccttagtttctgtcacctccttcccagtcagtttgtctgcctgtctgtctgtctgtctctctctctctctctcttaggctcaccatcattccctttcagccttggaggggagcaggtaagagcactgactttcccagccctgagctccagggcctccttgtgtagatgagaaagttcttacctgggtcaacgatcactttcacttgagtcccaaggtcaggtcctcttctttcaatcccacaccagtaaacatctgcgtcatctcgcctgagcccctccatggtcacagtgaacgtgcggtctttctgattgtccttgatggacacacggtcactcttctctccttgctccgaccctctggtttcaatgaggatcttgcatgtatcccagcgcacccctcggcaccaccacttaatgtaggtctcccatccttgcttatagtggcattgaaccgtcagggacccctgctctggggctctcacagactctgggccttggatggagaaacagcctggaaaacagaatcccaagatacagctcattgcaccggcacgaacccctgctctggggctctcacggactctgggccttggatggagaaacagcctggaaaacaaaatcccaagatacagctcctgttgcctgagccagtttggtgtttaagagtcccgagtgtgtctctagcacacccgattcctcatccccatctccctctcagtccattcccccaccagcttctagacctgcttagcatgtgacaccatggtctcctaccaccttctttccttgtcctctcaatgctgttttcatcggagccaaatatttaacaaccagccctctgggggaaaaaatctctggtttaggagctgggcacggtggctcacacttgtaatcccagcactttgggaagccaaggtgggcagatcacctgaggtcaggagttcgagacctgcatggccaacatggtgaaacccagtctttactaaaaatacaaaaattagctgggcgtggtggcagtcacctgtagtctcagctatgcgggaggctgaagcatgaaaattgcttgaacccgggaggcggaggttgcagtgagctgagatcgcaccactgcactccagcctaggcaacagagtgagactcttgtctagaaaaagaaaaagaaaaaaaatctggttttaatatttgccaaattccatagtgtaaatactcccacggtggcagatgtcaggtaatccatgtgatgtcactggacacagagctgggaaaagatgtcccaagccagctcctgtgagccagccccagcacactgcgggggtacccagggttccctctccagccttcatcttgtctcacctgacaagcctccatggagggagtctctccatttccatggctttaatgattacctgtttcctgatgattcccaaatccatatttgcagctcagactccccttagctagcccaccatttacaaagacacactggatgtctccaccccagattccttcgttgcagaattgaatgcacttcctctcccaccctgaactactcttcttcagtatttttttctagtggagcaattggatgtggcaagagtaacaaaggcctggtgaaagctgaacaggttagaggtgagcataatcaaatggcagtccgtgcctccgctgattgactccagttaggctgtgtgtagataggctctttccttggcaatgacacgggtttcttgatcacgcagaagtggataaacaggcagagaatcacaggggaagcctctcttgactgtctcttggcctcagagcttcaggcccaggccaggggtctctgcagggtggagaaagccaggtctatttctccaggcagatgccgcctcctcacagcttgggccttctccttgaagctgtgttagttttcttgaactttgcattcgtggttggtagaataatgtcccccatagctgttggcatcctcatacacagaacctgcgaatatgtcccctgacatggccagagggactctgccgatgtgatgaagttaaggaccttgagacaggaagaatatcccgaataatctccatggatattctaagtgaaagagggttgagggagagtccaattggaagatggtctgttgctgctttgaagtggaagaagaggccaccggccaaggaaagcagatggcttctagaagctggaaaatgcagggaaacagattctcccctagaataggggttcccaaccccaggacaacagactagtaacagcccatggcctgttaggaaccggaccttacagcaggaggtgagcggtgggcaagcaagcgaagcttcatctgtatttacagccactccccgttgttcaaactaccacctgatctccgcctcccatcagaccagcggccgcattagattctcatagaagtgagaaccctattgtgaacttcgtgtgtgagggatctagattgcacacactttatgagactctaatgcctgatgatgtgtcactgtctcccatcacccccagatgggatcatctagttgcaggtaaacaagcttagggctcccactgattctacattatggtgcagtgtataatcatttcattatatattataatataatagtaatataaagtatacaataagtgtaatgcgtttgaatcatcccaaaccatcctcaccccactcctgatgtggaaaaattgtcttccacaaaaccggatcctggtgccaaaaaggttggggaccactgctctaaagaaacccaaccctacttgcacctcaattttaaccagtaagaccacgccaggctctggtcttcagaagcatcaatgagatgatgaaattgtgcagttctaagccatagagttcatgttaatttgttacagcagccactggaaattcacatggcattcaatcagcagaaccaacttgattctcttcaaaccagcagctccaccacccagccttcaggaagagcttggcatcttctttcatgctgtcctctccttcagcccccgagctgattggtagccagtttagtcagctctatcctagagatgctcctcagtttttttttttcttctttcagtctctgccatcgcaggccacaaggacagcatgacatcagagagagtgtgagctttgatgcagaaagacttgacactgaactagttgggaaaccctggcagagttgcttaacctctgcaagtatcgcttccttattcataagacagtcatgctacgctctactttgaaggtggtaataggacttggatgtgtgtaggctgggcaaggtggctcatgcctgtaattccaaagctgtgggaggctgaggcaggaggatcgcttgagcccaggagttccagactaacctgggcaacatggtgaaaccctgtgtctgcaaatgcaaaagattagccaggagtggtggtgcatgcctgtggtccccactgcttggggggctgaggtgggaggatcgcctgagcctgagagttcaaggctgcagtgagttataatcgcccaccactgcacttcagcctgggtgacagagtgagacactgtcttcaaaaaattatttatttttaaatttaaaagaagacttggatgtatgtccaacgccagacatttggggtttgctctgtcagtgacagctcatcaacaggtcagaacttcatctgtgcctggatcatggcagtggcatctggagaggtcttcccagccccagcagcatcctccccaactctcctctcctgaggattatggccttcataatcttgtcttttgtgtttccaacctcatatccaactcgccacccccaagatgtcctgcacactgacagctccctcagctttcctctccatactgctgcctgagttgggtactgagactgtctcctcctcctcatcagctgcacttgccctgagcatctaaaagtcttttcggggccgggcacggtggctcatgcctgtattcccgcactttgggaggccaaggtgggtggatcacctgaggtcaggagttcaagaccaacctcaccaacatggtgaaatcctgtctctactaaaattacaaaaattagccaggcatggtggcaggcaccttaatcccagcttcttgggagactgaggcagaagaatcactcgaacctgggaggcggaggttgcagtgagccaaggttgcaccactgcactccaacctgggtgacagagtgaaactccgtctcaaaaacaaaaaacaaaaacaaaaacaaaatacccaaaaacataaattggatttgtcagcaatcactaacagcagaaaagagatgctgctgcattgaacaaagtgtcatcaatcccagcttcagtcattcaaactgtaaatggctcacgatgtaattagtcccgtttaaaaaaatatttgggggtttctctaaccacagaatatgatggctggaactattaatcaggcttctatatgttgtcaagagttggtatgaggaacgatagagatggaaatgacagggcagccgtcagcttggagcagagccccgttgaacgggctgaagggtggaagtccagccaggactggagtcgggtctcagaactccccagccatgctctttcctgttgtccctccgtggactgctctatctgtgccagatggtcagtccctaggcaccagcagaaaactgtgtggcccacacacattgcacaccctgcgtaaaattctagattgtcccctaatgccctctaggtgtccaccaaggtttgccatggagaagatcatctagcccttcccactttccacctgggttcttgagaagttttttctttgaaagtctcagctcctgagcctggcgtggatggccttcataatcttgtcttttgtgtttccaacctcatatccaactcgccacctccaagacatcctgcacactgacagctccctctgcatgaatccaccattctttctaagcctccatctctctgcccaggtcccccaacacacacacacacacacacacacacacacacacacacacacccaactctctagagtgttctcctctcagctctgctccagagactgaccttccttctacaaggcacatcaagtgcacagcttcgtgagtctttctctagtcaccagagagaactgcttcatcctccgcacacgcctccaccaatgccttattgtgtcctgcaattgctcattgtttatgtgtatgtctcacccactaagccatctggagtctttttactttattttttttttgagacaaggtcccactgtatcacccaggctggagtgctgtggtgcgatcataactctgcagaattgaatacctgagctcaaaggatcctccagcttcagcctcccaagtagctgggactacaggcacggtcaccacgcccagctaatttttgttcattttatatagagacgaggtctcaccatgttgcccaaactggtcttaaacgcctggactcaagcaatcctcccaccttggcctcccaaagtgttaggattataggtgtgagccatggcctcaagcctggagtcttctttaatggccagttctcctcctcttttttcttgatgtcctcaggccccgaagcacacgatgtcagtccccagtgcacctttgtcgaatgacttcacaaagccacctctcatttccctggatgtggaaggacaaatgccctctgcctcctgccctgcccctgtcataccaagcgcccaaggccccagccccactcacctgagaggctgagaaggagcagagcagggggcagccacatggctctgccttcccggctcctcgtccgcctgatctgcaaccagtggcaaatgcagatcccagatgcactctggaagttctgcctgagctctggcttgcaccttctgcacatctagaccgcctttgactttcttactcattcacttccttttatagagtgggtagttcctgcttttaattattaaacgaaagaggtgtcattttttggcagggctgcgccacagggcttaagcatcgtcactatgtaaaaaagaggagggaggggactgtgcagggtctttagggtagggggagatacgtctgcagaaggggtggggtggggggcgtctggcctagcaggccttgggtccaaggggtataacactctgggagtcaatttcagagctgttctataccacagtgaacacccaactcagatgtcggatgggtcatgctgggcacacctgaacatgcatttgttcaggtgttatagccaagtgcataaacatgcagactgttgggtcagacagacctggctctaaccccacgagcaccacctacaagctgcgtgactgtggacaatgcaatcaacatctctgtgcctcagttattgtatctattaactgggctcataatgtttgttgttgttataggagttattaagaaattattttaggtagataggaaaaggggtgcttgggaagatttttttttcttttaaagcagctccataaatgtttcttgtctagaagaaaagccctggctcttagagctgggcaggcaagctttgatatgcaaatacaggccattagaaactgcgtccacccaaacatggagactcccgcctcttcttcttttccccacgttcctggcaacatggccgcccctacatacacccatgtgtgtagaacatcatggcgcctgtatttgcatattaaaaggctagggtaggaaggctagttttttcgtgggctacttgaatgacatacctggtcaaaccaatcccctgggccctatgcaaatcaggtaccgcctcctccagcctcctcatataactggctgttttccaccgtactcgaggttccctctttcagcttggagcccgcctccctcagtctcagaacagggggagcctcttccttccttctttcttgtctattaaattctccactccttaaaaccactccacgtgtgcccatgttgttttattcaaaccagtgggagaccaaggaccctagtgttcctccagtcatcagagccataccattttgttgcattggccgggaatccaaggtacgacactcatcggagtggtaagtatgggagtgagcttaaaatctcttctatcattccgaggcactcttagcctctattttaaaataaaataagtcaatgggcatccgtcagccgggtacatacacttagtgttggctgccatactgaagactcgaatgtgaggcttgctgctgagaacacggagaaccccccaacacccctgggtcattgggaatgttggccatgttttaaatcagcttcttttcacgggaagacctcgccattgtgcaaggctgggaaaagttctaaggcaactaacaatttctggccagagcacaccctggcatgattcaaaggcccctggactggacccagcctctggcggcccattctgggtgttggcaaagaatcctcaactatcttgtcacaaaactctccttccttctctatctgcggtctcttacactttctttgtgtgaaatgtgtagcgagttttacagcctaggaaagtaatcctgttaggcaaaatcaggaagatgcccttgcaatcttctaggaacagagttctcccctttctcccaccgtgaggttactcactaccacgtctctagtgagcacatagtatttctaagccaacagtgccacctagtagaaatagaaatcctctacataaagcatattttttcatggcaaaccgcagcttctttttgcatgattagaaatcaggctcggccaggcgcggtggctcatgcctgtaatcccagcactttgggaggccgaggcgggcagatcatgaggtcgggagatcgagaccatcctggctaacacagtgaaaccccgtctctactaaaaatacaaaaaaaaattagccaggcgtggtggcgggcgcctgtagtcccagctactcgggaggctgaggcaggagaatggcgtgaacccggcaggcagagcttgcagtgagccgagatcgcgccactgcactccagcctgggcaacagagcaagactcggtctcaaaaaaaagaaaagaaaagaaaaggaaagagagagagagagagaaagaaagaacaagaaaagaaaaaagaaaaagaaatcaggctctaggcctcttcttgaaatgggaaagttctgcctttagcagttaggagttaagaagtcttccatagccaaattttagtctcaatattgtcccattggcaggaaaatggccattcggttcctacattcctttaaggcacctattctgtctccgattaagatggtacttaattagtaaggggatttttaagtccagaagttaaccagaaccatttttctaagggtaaatgctttagcacaggccataataatagcaagatataaagttcaatctagcacgccccctcccttaaagaggctttgcccaattatgtagtttttctttttttttcttttcttttctttccttttttttttttttttttttttttttgagatggagtcttgctcttgccacccaggctggattgcagtggtatgatctcagctcactgcaacctccacctcccgggttcaagtgattctcctgcctcatcctcccaagttgctggaattacaggtgcccgctaccatgtgtggctaatttttgtatttttagtggagacagggtttcaccatgttggccaggctggtcttgaactcctgacctcaggtgatccacccaccttgccctcccaaagtgctagaattacagacataagtcaccacacctggcccgtagtttttcttaaaatcgttgtttttttgttttgttttttagggaagcacacaggtcacacaggaggtcaaaaagaaataaaagactaaggtgcttgtggaagtgtaagtgggcccagaagtctagtttctctggtgccatggcttggagggtcacgcctgcagtcatggccagcacatttaaatgggtgccaggatccaggaaccagggaaagaaaatagttgggggaacgccccctactgtgttctccatcctggatcacatactgaaaggaaggagactaaaataatgcttttattctcacttctctttctagatgggtaacagatcgtcttctctgcactccaacctgggtgacagaatgaggcttcatctaaaaaaattaatataatgaatcacattaatagaataaagaagaaaacccacataatcatgtaaacgcacaaaaaccactatctgaaatccattacttttcatgataaactaggaattaaaaggtgcctataagcaacccattacaacccatggcaaaatctttcctttagaatcaggaagaggacaagattgctcaaaatcactactttgattcaacactttgattagcctgcacaatacaacaagaaagagaaacaaaagacatgagaattagaaagaaaaacaaagctctaaattattctagattaattgattatctacatataaaactgaaaacaattactaagattttttgcagagttgctaaatatatataatcagtaaggatcaattgtttatctacatgcatgcaatgaataacttgaaaatgcaataaaagatgccacaaaatggggcggggcgcggtggctcatgcctgtaatcccagcactttgggaggctgaggcagatggatcacgaggtcatcagttcaagaccagcctgaccaacatggtgaaaccccgtcttcactaaaaatacaaaaaaattaactgggcatggtggcaggcacctgtaatcccagcaacttgggaggctgaggcaggagaatcacttgaaaccagaaggcggaggttgcagtgagccgagattgcaccactgcactctagcctgggcaataagagcaaaactctgtctcaaaaaaaaaaaaaaaaaaagccacaaaataagaataaaaacataaaatatccagaattacacttaacaaatatatgagcaaatatcaaggagaaaataatagaatgttattaaaagacattttaaaagctcataaataattagaattacataccatgttcatagacagagaaattattataaagataaatttcatacatttacatttaaagtctcaacataattttttttcttttttagtacgttgactggttaattctaaaatttctgcagaagaggaaatggccaatatttgcaaagacattcccaatatcaaagaacaatgtatagtgacatgacttaccagataacaagacatttaaatacagctatagtaattaaaacaatgttgtcttggttccaaaataagcaattaggcaaattcaacataatagagtggttagaaaaaggtccaagcagacatagaaataaacacctgccaggggttgcattgcagattgctgggaaaatgtggataatgcttatccaaatggaagacagaaaaatggattattatctcagcctagaaacaaaatcatttagaaatgggtcaaggacttacctgtgaaagggaatatttaaaaaattttagaagaagatataggataatttttttttaatttgggagtatccataattggttaagcaagatgaaagtataaaccattaaggaaaatgaataatttgtacattaaagtgaaaatcctgtttctcaaaagatatcataaagccaatagcccaggaaagtatatgtggagcaccagtaactaacaaaagacttgcaaagaacttctaccaattggatcatgaggtcaggagatcgagaccatcctggctaacatggtgaaaccccgtctctactaaaaattcaaaaaattagcaggacgtggtggtgggcgcctataatcccagctactcgggaggctgaggcaggagaatggcatgaacccaggaggcggagcttgcagtgagccgagatcacgccactgcactccagcctgggcaacagagcgagactccgtctcaaaaaaaaaaaaaaaaaaagaacacagacaaacaacagaaagtagatgaagattagaagaggcatttctcaaaagagaaaattcagataaccaaaaaacacatgagcatgagtttaacattagtaagcagagaaattcaaattaaaacaatgagataccatttcatacccattaacttgaacaaatttagaaagtctgataagattcaagcaggagcactgctgataagaagcaaaaattggtgcagttactttggaaaataatttgcgcttgcctagtagagctgattacacacatgcagcaaaacctagcaattattcccttagaactctactctaggagacacttttggacagacaaaattaggatatatgttcataataacgttataagtaatggcaacacaaaaagaagagaaggaagaaaaggaggaggaggaagagaaaaaagaagaggaggaggaccaagaggtaggaagagcaggaggaagaggaggaaaaaaagagggaggaaaagaaaaaagaagaaaaggaggaggaggaggagaagtaggcagaagagtaggcagaaaagagtagaaagaggagaaaggagggacaagaggaggaggaagaggaaggggaagacgagagagaaaggatagagaaagagaaggaggaaaataagaagagcacaaaaaagagaaagaaaagaaacaacctaaatgcctgtttaagaaagagggatgtgcgagttatggtatgctcatacaacagaatgtagaccaatacaaagaagtgacacatcagtgcgtcaacacatcaacatggatgaatctcaaaaataaagtgttgaatggtccaggcactgtggctcacacctgtaatcccagcactttcggaggctgaggcggatggatcacgaggtcaggagatggtaaaacccctctctactaaaaatacaaaaatttagccggacatggtggcacatgcctgtagtcccagctactcaggaggcagaggtgggagaatcgcttgaacctgggaggcagaggttacagtgagccgagatcgcaccactgcactccagcctgggtgaaagagtgagactccatctcaaaaaaaaaaaaaagtgttgaaagataaagtctgattgcttagaaataaaaatgcctaatactattcacagaaagttcaaaaataaacaaagctaaacaacataccctttggaaatccatatgcatgtatgtggcaaatcccttaaaacaagatgatgatgaacataacaatcggaatgtgagccaggtgctgtggtgcatgcctgtagtcccagctgctccagaggctgagacaggaccaaggcttgagcccaggagttcaaatccagcctgggtaacatagtaagacccatctctataaaaaaagatacaataaaataaaatgtaggatgtggttttctgagagaaggatagaaaagaaattgcataagatcagcaagcggtttggggcttcatgagtatgaatgatgttctattacttaaactggatggtgggcacacacaggttaaagagtattcttggtgtaaagtgcatgtattcttttgtgtgtctgatacatcacaagaaaaaagcctccaaatcttctgatagaaacatggatttgttggtcagaaggccattcccatatgtaagagggagtatgttgcttggcgcggtattgatgggcatcagagttactgtttctcacaatccagctgactctgcctccccaccgagcttctctgagccctgttcacccacaggacagcccccagcttgtttaggagcaggggaagctccaggaggatcaggagcaggatgtggagactgctgaggagggacctgtggggacacggtgacaggcagtgagttacctccccaggggaagacctggtgccctccaccttgcccctatctccagtgccaaggtactgtgggcacaaaaatcaagaactaacctggacatagcagccagatacataagaccaatggcctctaattatcaccctaagaattgccttgagattcagggctgtgggctgaggcagggcagggcgatagcagcaatgtgaggggacacccagggacctggtaggacctgaatccacaagaatctctaccaaagccctttgtgtgcaggagcagactcttcagaggtgcaggaatcaataacctggatatctgtcgaatgcctgctcctctccagatggcatttcccacaaaggcaggagccctgtctagtcctcttcacagataaactggcacctgccctgtggctgcaaacatctatctgtaaaatttatggttgttgagcggcggctgctagtgtctgtcctgggtccactgtgatggccaggtgcctcccagggaacagacatgttggacaggccttcccaggaggcgggaacccaggtctgtccacactcagaatggctggttctcctgacatgatgggctcagggtgtctttaccctggaaagggcaaggaggctagtcagatacaggatttgcctcctgtctgtcccggagggcatcaccccttctccaccttctcatgccttaagcatattccttgactctcccaaccctcttacagatttccgttcctttcttcctatcatgcccaatagcaccagaggccgagcggagagtgacaggggaatcttggtggacctggcaccatgaaggggtcactgcacccttgtcctgcccagccctcccttcatttacactctcagggacagtgtgcactgcagtcattggtgctgatgcccccgactcacatcatgggactgtcgccagcccaatgcaatcccgggccttcccacctgcccagtgttcaggtctgaccttgacccagcttggcagtagctggccctgccacggggacctgacctggtctccccttctgctcttactcatccctttcattctccccacaatgagcaatgtgacccctgacacacacacacggccctggggaggcactgctgaactcccaatggctcctgctgtcacaggatggcacccacctgacctggcctctgcacacaggtcctggcagcccctatcacccggcaagtggctccaacctcctggctccaggttcacctcggtgctgccaccctcccgactcgggtctttgtccagaccctcaacctcccactcctctgcctgcctccagctgacaggtttgcctgcgtgttccttgaccttcctgggttatggtggcttcctttttaggggtcctcatgacccatttcacatttccctcttgtgtttatcactgttttgttggtgggtttcgtctggactggtagctcatggagaaccagggcagtatcttgtcctgatcacagctgtgacttgctgtcatcctggggtctgccaagggcaagtcaacaaattgcttgttgaatgaatgaatgaatgcatgactctctcgagtcttacctgccttcagaaaacttaattgtctgatgctggtgtgccatatccagctcaggctggggaggagacagagaatgctatctgcaggccctggagccactggatccagagagggatctgcttcctgtgttttccagatccaagtctaagatgcccccctggcaggacacatgcacctgctgctctctctgcctcagggctcctcctccagggatcctggcgctcacccccctcctttctcctgatccctgcttgctcagcgcctattagaggggcttcatcacagacccctccactcctgcaaagcagtcaccccacttctcttattttactccgtggctcttttcacctctgtcttttacattacctctggaacatattcatgtatttttgcatttgtttatcatttctatcccccacctggaatatgggctcagtgtaaacagagctccttgcctgggtgttcacggctggactccaatgccaggtcagtgtctgatacaccaaaagctcccataagcatctgccgaatggaaaaaagggttaagaaccccccaggcgaggccctccttgaccaggaggactcatgggaatcatctgcctcacaggggtcttgggtgttggccaggtcatcatggcgaccctggaactgaaatggtgggcaaatgataacatctttcgtctgtatagacagacatggtctacactactgagcaaaagactcacttaactaccacatcaaggagtcatagccctccatccgtttccaaatttgcaccagttaaaacccacagccctggaatgaaggagaggtcaggtccccttgaagaaggaggaagggtaggcctggttatgctaccacagttcacactgagaatcttctaccagctctcccagagggacctaaagacactggccaggatgtgtctacctgaaggagggaatagtcaggctttgggggaaattctggatccttttctgcagggacccccattccgagaggcctaacatggggcttggtccactattctcagcaaaggcctgtggaaatcagggaacaatggatttctcactcaggtctgactgagtgggcctgatacatcccaaacctacacattgtcatttattaaagtttgaaagcatcattgaatcgacacactcagcaaatggaagcagccgcatattctacactcctggacccagggagtgtgggccattatggtggcaaaggtgcaggggagtcctagacctgcttctccctgtgaaaacggtggaggaagcagtgccaggctcctggagaaatggaagggtgcagggagggcatccgggcactcagaggtattgctgacggcccgaggcttagctggccggggcgtgcacatgagacgtggactcacagctcagggcgtccatgtccgtcaggttcacatgtgacacatgaggatcgggcacagggaaaaggctgaaggaggctcacaaaggattccaggagatgtggagagagcagcccgggagggagtggtcaggaggtcattccagtcccccagaggggctctgttgcagcacagggccttgatggacagcagatgctactggttctcacccttgggccaattctgcctgcttctagagcttctctgaggtctgttcacccagaggacggcacccagcatgctcaggagcaggggcagctccaagaggaccaggagcaggaagcggacattgctgaacagggagctgtggggacacggtgacaggcagtgagtcacctccccaggggaggcccaggtgccctccaccatcccctgacccttgtgtcccaatcctgtgaccacagccaaccacataagcacccccctggacagtccatcccgtctcagcatcacggcccctaaccctcagcctcggatttacccttgacctgaggactgtgacacaggaagggcaggaccatgagaggacgtgaggtcacgccagggatccaggcagggtctgtgtccaggacgcagctgtctacctctgtgctccccatggagggttacccagctggggtcccggaattcacaaagggttatttgtttggtgtcaactctcctgtacacagcgtttccaggagggcagggaccatttgtttcattcacagtgagtacctgctgcctacccggagtctccaataatctgccctacaacttcagtggttgttgaaggaattaatgaatggacagctcagctctcagctcctcagaggactgggcttatcaaacaggatgaaactctggccagggctgcgagagaggcaggggagaggaccagggccaccggaccccagagcatctgcccccttccctggcctggccaggtcccaaggctcctcgcaggacatttgcctcactcctccctccacctggacccttcttcctccagaccccagagtgcccagcccccaacccttgaggtctctgtgctcatgtcctctaattctcaaaccctcttctgatcatcgtcagtgaaatagcaactccaacacctgcacacgctctccccaaacccaagagtcaaacatctcatcccagcattcattaccctttgctgtatttgtacatcagcctctgtgctgacttgctcaatgcgtgaatccacgcagtagaactcaacttccaccagggcaggacagtggctgtgtggttccctgctgtgacccaatcccaaaaggagcgcctgacacttaatagaaccttcacgtttggtgtgggaggtgcgaacaaagaagggactggaagaagggacatccgagtcccctaaacatcacacgcagtggggaggccgccagcgtggcccagtcctatgcgcaggcaccttacccagggtgtgggctgggttcggggctgtcctttctggtcacgctgggccaggtgtgcacgggcagcttcgtgggaggacctgaggtgcccatggagctctgggggctggaggctgtggtcgtcccggctgtgggtgaaacacaggtcaaccttgatgacatcacatgggtctcccacttactctcacctgttctgctccaattttcacagacaaggtcaccaatgatgtgctggacagatgccctgcatccatcatgccccacggccacacccaggcctgaccagggtcctgggcctctccttgtcccatccctaggtactgcagagccaggacaccatttcagatgtgagagctgccctgctcacctgtggcaaaggtacgggtctccaggtttcaccccagccagggagggacagggtgacctgggggaatggggtgatgtttactctgcgaagggtgacccagagtgactgcgaagccagggccctgggcacagcagtggctggagagaggctggaagtgaggacaggaagtcagtggggtcctccctgaacgatgggacccgagtccactcagccccaaatggcagccatgctgcggccccacaaggccattggaccatcctctcagcaggagggaatgcccaggaagaaagatctagagaggggatgcccggtgaagcctgggcggcggcccgtggtgaatacagctggataagggccctttcctcctctccctggcgccctcaggtgggatcttagctcctcactcctagataggaaggcacaaagggcgcaggagggacacgtcgcccccggggaaatggagaacaagaagatgctccgaggaacctgggacattgtcagaagaaaacgatggaaaagcaaccacactgaggccactgggtttgtgtcttgtgagacaggagggggcctttgagggaagaatgatcttcggcacgggaaagggccctcaggtccgtgccagtctcagctcatttccatccacaggtccctttgcctgagggggcaatttctggggttccctcctgtggtaaaaggtgccagagaataagggggacacacaggtcagcctcaggggcaggatgtggttcccaggagcatgagaaccccacccagggctctggggctccttcctgtgtcctccagtggctgctgcaggagctcccaggacagggctgtgaggctgcggcctcaggaccctccagacagggcggcatccatgcaggccccagggcaggggcagccttgagtgagaggagccaatgatgggggggtccaattccccgtggggaagagcgagttagacccaggcgggacagtgggcacccttcagtatggatccggcccttgtcaatacagggaggtagcaaggaccccagagtcaggggtggcctcacagaccccacccaggaaagtttcaggcctgaggccgtgagggagggcccacagcggggggtctccagccacagggccagggtgcttttgtgggcgcccaccctcccaacacacacatgcaggtgcacacacacacaaaccacaccacaactcctatgcaggcacgcatacacaaagacgcactcacactcatccacacacagcggcacacagtgtcctgactcaccaacccccaggctcacaccctcctgttccacttctttcttcagggacagaatgaccagccctaggctcaggcaggcctggtgctgagaaaaggaggggctcacccgggaacacggacacctcaacctcgacaatgggatcatgaaagtctcggagccacggtgtatccaccccacaccagtaggtgcctgcgtcctcctctgtgagattctccagggtcactgtgaagctgaggtttgcaggactgtccctgatggacactcggccattccttttccctgctgaccctttggtctccacaatcttgtcacatcggagaatctgtggtggtctgcaccagaatttgttgagggtcctgtgttccttctcatagcgacactgcacactcagggatccccccacggggcccgccacggtcatggggtggctcagaggaaaatagcctgaaaaatacaagccaaaatcctgtctccttaccagaggggcctggtcaggggtgccgcagtgtcagcccctcatggaccctgggcgtgtggagaaggcaatggcaggcaggcagcctttgtccacccaggaacagggactgagggtgggaggctccctctgtgcagaggtgggaagggcatgggaagtttccatggagactggaaaggcaaggctagggaaacactgggtgtgtgcgggcctgtgtgtgcatgtgagtgtgactctgtgtgtgtgactgtgtgagtgtgactgtctgtgtgagtgtgactgtgtgtgactgtgtgtgcatgtgtgactgtgtgtgcatgtgagtgtgactgtgtgtgcatgtgtgactgtgtgcatgtgtgtgtgagactgtgtgagtgtgactgtgtgtgcatgtgtgtgagactgtgtgagtgtgaccgtgtgtgcgtgtgagtgtgactgtgtgtgtgatcgtcccagataaaatttgtgattggataactttggcaatgacagtcacagcatcacctcccaccagggcttcctgtctcgggcacagaggaataggcctcccccgtgctgtgccctgccgcctgctgtcccctggtgaggcagctgctgaccgctcctgggtgctcctttgccctcctcccctctccctgccccactcccctctatgaccgctactccagcgcctgcacccctccctgccctctcccactcaggacagagctccccaagtccagggtcggcccactcacctgggacaagcaggaggagcagagctgaagaccgccacgaggcccaggccctggcagtcattcctgtaacacgaatgtcacctgccactgtgcaagaccccaggaggggacaaaatgtaatctcctcccagcagatctgagcttcgcttctgcttttcttctgctctctgcttccttgtccagccctgtctcaggtctgaggctggagagggtcagggtacaggaagctcagggagagagccgcctgggctgaggccggtgctgacagctctgggatggtgctagtggctcctctcaaccctgacgtctggcaaagtccagggtcccttgggtggcgatgcagccacttccccacagcccacagcttctggcttcagtgtgttactcacactgcagaaggcagagccaagctgggccatttcctaccacatgggctgctccaccctctgtgacatgtcacttcctggtcaggatggacaatcttgtggttggaggctaaatctgccaccttctttagccttggaggtgaccagagagaggttgtgtcccttaatcttcagctaggtccccgcagagacctctgcccctaagacccccagctcttcttctggcctcagaagttagcgctatgaacccagacaccatctgcatgtccctttttggtgctgagtccccaaccaggttaaaatcccacaggcttggggagttttcctcttgtgcccctgcccccagacctacacacacagcggcatcacccacccgagaccctccttttccatcttgtcttcttgccaaaatccatgccccagtgggaatcagggcagagaactgagaatagagagagagttcagacatgtgaagatgctgaagtgggactttgtggaggatgtgaggctgcgactgagccagcacacaccccagggcacacggaggggtgtttggtgactgagaggacagtttgtcatgagcagcggctgctggtgtctatcctgggtccactgtgatggccaggggcctccgcagggagcagacatggcagacaggccttcccaggaggcgggaacccaggtctatccacactcggcatggctggttctcctgacgtgatgggctcagggtgtctttaccctggaaagggcaaggaggctagtcagacacaggatttacctcctgtctgtcctggagggcatcaccccttctccaccttctcatgccttaagcatattccttgactctcccaaccctcctacagatttctgttcctttcttcctatcagagtcaatagcaccagtatgtgcacacagccatgaggttgagtggagagtgatgggagtctgggcaaacctggcaccatgaaggggtctctgcaccctcgacctgccctgtcctccctccatttacactctcagggacacagcatgcactggggtcattggtgttgatgcccccagactcacatcatgggactatctctagcccagtgcaatcccagggcctccaattagcccagtgctcaggtctggcctgggcctggctttgaagtatcccggctctttcatgggctgacctggtctccccttctgctcatacccacccctttcattctccacagaatcagcaatgtgatccctgacacacacacatggccctggggaggcgctgctgaactcccaatggctcctgctgtcacaggatggcacccacctgacctggcctctgcacacaggtcctggcaggccccagcacctggtaggtgtctccagcctcctggatccaggttcacactggtgctgccaccctccccactcgggcctttgtccagaccctcaacctcccactcctctgcctggctccagccgacagggttgcctgcgtgttccttgaccttcccgggttatggtggctcgctttttaggggtcctcatgacccatttcacacttccctctcgtcttcctcagtctttctgttggcgagtcaatgtctgctcccatctagggtggccgccccttgagagcaggtgcagcctcttgtctcattcacagctgtgcccgttatcattccagagtctgccaagtgcagtttaacaaactggctgttgaaaggatgaatgggtgaatggatacatgacatcctgatgtcccactgcctcagaggacttagtcatccaaagttggtgcaccatttcctgcccaggctggggaggagacaggaaatgctgtctggaggccctgaagccacctgacccagggaggcatctgcccctggcaggacatgtgcacctgctcctctctctgcctcagggctcctcctccagggatcctggcgctcaccccctcctttctcctgatccctgcttgctcagcgcctattagaggggcttcaccacagtccccctcagctcctgcacagcagtcaccccacttctcttatttcattccgtgactcttttcatctctgacttttatatttcttctggaatttatgcacgtatttttgcatctgtttatcatttctatcccccgcctggaatatgagctcaatgaaaacagagctccttgcctgggtgttcacggctggactccaatgccaggtcagtgtctgatacaccagaagctcccataagtatctgctgaatgtaaaaataggtgaggacccccaggcgtgtccctccttgacctggtggactcatggggatcatctgcctcacaggggtcttgggtgtggcatccctggaaccgaaacgatggtcagctgataacgtcttcctttgtctggataagcagacatggtctgcactagtaagcaaaagactcagttaactaccacattaagaagtcacggccctcaaccaatttccatatttgagtcagttaaaagccacagccctggaatgaaggggaggtcaggtccccttgaggaaggaggaaggaaaggcctggctaccatgccacaactcacactgataatcttctaccagccctcccgcagggaccagaagacactggccaggatgtgtctacataaggaacggaattgtcaggttttggggggaatcctggatcctcttctgcagggaccccagtcctgagaggcccagcctggggcttagtccactattctgagcaaaggcctgtggagatcagggaacaatggagttttcacccaggtctgacttagtgggcatgataggtccagaatctatgtattgtcatttcttaaagttcgaaagcatcattgaattgacacactcagcaaatggaagcagccacatattctgcactcctggacccggggagtgtgggccattatggtggcaaaggtgcaggggagtcctggacctgctcctccctgtgaaaacgttgaaggaagcaatgccaagctcctggagaaatggaaaggtgcagagagggcatcaggcacttagaggtgttggtgacagctcgaggttcagctggccagggcgtgcacatgagacatggagtcacagctcagggcgtctgtgtccatcaggttcacgtgtgattcatggatcaggcacagggaaaaggctgaaggaggctcacagagaattccaggagatgtggagagagcagcccgggagggagtggtcaggaggtcattccagtcccgcaaaggggttctgtcgcagtgcagggccttgatggacagtagatgctactggttctcaccctctggccaactctgcctgcttccagagcttctctgaggtccgttcacccagacgacggcacccagcatgctcaggagcaggggcagctccaggaccaggagcaggacgtaggggctgctgaacagggagctgtggggacacggtgatggcagtgagtcatctccccaggggaagcccaggtgccctccaccttctgcctgtctgtgaacccaggtcctgtggccacacaaatccctgtgaggacaaactctgtatatgacaactcctctaaagagatcattagaccctgaccttcagcctgagagtccctggagtctcaggactgcctataaggaagcacgtggccgtgaaaatggtgcatgaggacagggagggatccaggtgagaaccacacccacaagatctctacatcccggggttattcactggcgcatggaatcagtcatgtagtttgatgcctgtatggccatcatttcccgagaaggtgaggactattcatgttattcacaagtaactggtacctgccctctggttgcaaatatcagcctgtaaaattcatggttgttgaaggaatggaaggaatgaatgaatggcccagctcagctctcagctcctcagaggactgggctcatcaaacaggatgagactcgggccagggctgcaagggaggccaggggagagggccggggtcaccgggcaccaaaacatctgccccctgccctggcctggccgggtcccaggactcccttgcaggacatttgcctcactcctccctctgcctggacccctcttcccccagaccccagagcgccctgctcccaaatcctgcaggtctccacgctcatgtcctctaatccacaaaccctcttctgatcattgtcagtgaaatagcgactccaacacccacacacatgctccccaaacccaaggcacaaatatctcttcccagcagtcatcaaacttcgctgtatttgtctgtcagccactgtgctgacctgttcactgtgtgaatccacctggtagaacccaaactccaccagagcaggactgtggctgagtggttccctgctgtgaccctatcctgacaggagcacctggcacttagtaggaccttcacattaggtgtgggaggcgtgagcaaagaagggaccagaagaagagagacacaaccatcccatctctccccagcctacaggaaaggctgcccaggtggcagtcctgggggcacgaaccttaccctgggtgtgggctgggatcagggctgtcctgtctggtagagctgggccaggtgcacgctgggacgtaacgggaggacccgaggtgcccgtggagctctgagactggaggccgctgtcagggctgcaggggcatcacaggtcagtctcggcgacctcgcctgagtctcccactcatcatcacctgttcagctctgatttccacagacacgatcactcagtacatgctggacagatgccctgagtccaacacgttccacggccacacgcaggccggaccagggccctgggcccctccctagtcttatccccaagtacttcatagccagatgagcactttcagaggcaagagtcaacctgctctctaggggaacgtgagagtctgtggaaagaagacctggctgcagaccccatcccagccaaggagggaggggtgacattcactctgtgaagcgtgacctagagtgactgcggagccagggccctgggcatggcagtggctggagtgaactggaagtaaggacaggaagtcagtggggccctccctgaatgatgggacccgagtccactcaaccccaaatgtcagccaggctggtggccccacaaggccagacactttcagggtggggcacacagaggagtctccaacaacaggtgcaaatgtgcttttgtgcatgtcagcacacacacacacgggtgcacacacacaaacacaccacacaattgtgcaagcacacacacaccacacctgcgcacgcacacacacacaccacaaacacaactcacacctgtgcatgcgtgcgcacacacacacctgtgcatacacacacagcaaacccatgcatgcacacacagacactgtgtcctaagtcactgcctgcaacctcacacactcctgtcccatttctcacttcagggacagaatgaccagccctagactcagacaggcctggtgctgagtgaagggggctcccctgggaacaccgacacctccacctggaagacaaggtcttggaagacaagatcttgaaattcttggagcaatagtctattgaccccacacaaatatccacctgcatcctcctctgtgaggctctccagggtcactgtgaagctgaggtttgcaggatggtccctgatggacactcagccattactcactcctgctgactctccagcctttacagtcttgtcacatagtagaaaaagtggttgtctgcaccagtatttgttgaaagtcctgtattcctcctcatactgacactgcacattcagggatccccactgcggtgtctgtcatggtgctggggccgcccacagcaaaacagcctggaaaatacaagccaaagtcccagcttctcctcagatgggcctgggtcagggatgttctggggtcagggcctctcggaccctggggttgtagaggagacagtggcaggcagacagcccttgtccacccaggaatctgaactgaggggtgagtagctccctccctgcagaggtgggaacggggaggggggtttccatggagacaggaagggcatggactgggaaaacactgtgcgtgtgcatgcctgtgtgtgcacgtgcatgcatctatgattgtatgtgtggttcatcaagatggcatttcggattggataactgtggcaatgacaatcacaggcacctctcccccagggccttctctgtcgaggatgcagtggaacatgactcacctgcgctgtgccctggagcctggcactcagctagtgaggcagctgctgacagctccttgatgctcctctgtcctcctgccctctctccatgtccctacttccatgtccagggcccacccacctgagacattcaggaggaacagagctgccagtagccgagcagcccgatccctggtggcctcttctcagatgtcacttgtcactgcatcaggctctggtaggacaaggtggagtcccctctcccagggtctgagccccacttctgctttctttccctatctgcttccttgtccagccctgtctcaagtctgaggctggagatgggagattgcagaaagctcaggagagaagctccctgggccggtgcaggcacgcctagactcaaggggccagggaccaggggccaaggtgcaaccaggatctgaagctcaatgggcagttccaaccagagcaagtttcatccctaaagacaagtgcccagggcagggggcatccaggcaggaaagaggaggacacatctgattctggcccatggcttccgctatattgagaagcagcacacacactgcacgttgaacttctcacttctgggagaggaagagacacccaatgtccctactgaacatgttcacctaggctggaacttggtttggtgacaatcttcaatgcttcttatttgtgaacaagggaagcagtctttgaagcactaactataaccaatgccagacctaagttagattatctatataacttgtgaaccaaagtgtatctgagacaagtcgcaattaattttggaagtttattttgccaaggttaaaagtacatccatgacagcctcaggaggtcctcacaacatgaggtggtcagggcacagcttggctttatacattttaaggatacataagacatcaatcagtatattagattggtacaaaagtaattgcagttttgccattacttttaatgcactccagcctgggcaacattagttttaatggcaaaaatcacaattacttttgcaccaacctaatatgtaagatgtacgttggttcggtctagaaaggcaaaacaactcaaagtgggagggggcttccaggtcacaggtagataagagacaaacagttgcatttttttgagtttctgattagcctttccaagggaagcaatcagatatacatttatctcagagagtaaagggatgacattgagttacatctgtcctttgtccgtaaggaatttctttgtgaacgaattgtgagggaggtatgtagctttttttttttaaatcttagtagctatcttttttagcaatagaacgggaggcaggtttgctctaaacagttcccagcttggctgttccctttggcttggtggttgtggggtctggagatttattttccttccacaaacttcagggctggttggcagaagtattgaacccatacatttatacgtatccttttattatctgcccccttgcagacagtgtcttgctttgctgcccaggctggagttcagtggcacaatcatagctccctgcagcctcaaattcctggactcaagcaatcttcccacctcagcctcccaaaccgttgggattataggcgtgagccactgcatccagccacaatcttctttttagagctcaattaattatactttattgctttttgtgtaccaagaaattgatctgtgaacttccctcatttaaaatataccgcaattttgtaaccttgttttttcatctctctctctctctctctctctctctcaaaaatagaagtggcccaggcccctctggaccttagggaggccctgaaggccagagaggaataaagcagatatgtctgattccagtccaaggaaagacattcactttgggctttaatctttgcttaattattttttcctttgcaaaagagaaagagactcaatttcctcagtgggtggctctatgatattggatgtgcagcttgtcgactccttaggcgttgtattctaagtttctctatggcaggccttgaaaaccaaacaattaatcaactccgggcaatgtctatggagaggtcactctgcatgtgagagggggacctccccagccagagtcttcctgagtttctgtgtggatcttcctgaatcaggtccttatgtgcaggcttgagagttgaagaaagaaattcccacagggtgcggtggctcacgcctgtaatcccggcactttgggaggctgaggcaagcggatcacttgaggccagaagtttgagaccagcctggccaacactgtgaaactccatctctactaaaaatacaaaaattagctgagcacagtggctcatgcctgtaatcctagcactttgagaggccgaagcgggtggataacttgaggccagaaattcgagaccagcctggccaacatggcaaaaccctgtctctaccaaaaaatacaaaaattagctggcgtggtggcatgcgcctgtagtcccagatactcgggaggctgaggcacaagaatcgcttgaacccgggtggcggaggttgcagtgagctgggatcgagccactgcactccagtctgggagacagagcaagtctatctcaaaaaaaaagaaaagaaagaaatccccacagggtcacatacacacgtactcaaacctaaagcccaatgtccactctcaaatcaccattgtctttgcactggttccctgttgaaaatttcaacctgtcagcacagccagggaccagcacagactgctttcagtttcgaactgtttcctgaaaagcaaaaggcactggaggagtgagaggagagggagagtgatgggtggaaggacttcgaaaacaatgactccctggagtttctcagtttgggtcgccttggccccctccgcctaaagcacccttctcattctgtttcctgagtctgaggattctgcttttcccttttgccatccctgggccactctgtcctcttcagtgtcctggtccagtgaagagactctagggcattagtgccggagaaatgctgacacgatcacttatactgtatgctttcggtcagattctttactctctcagagctgttggcaagatagctggaaggaggagagattaactctttctttggtggaaaaaaagatgaataaactgtaaccaaaaaagaaagtcaagcaaactttcagaagtataatctcatgttttggtttttaaattctttgatggaagtgtaacatacaaacaaaataatacaaatcgtaaatgtcggctcagcaaaatttgaggaaatgactacccgtgtctaacagccacccagatcagacacccacgcccttgaggagtctccttccatatggtatttgggtgggcctctgtgatccatagatatgagccacgggctatgacttccaagaataaaccatcaatggtactgtgccttgctctctcttggatcactatctccagggaaagctggtggctgtgtcttgaagactcacaagcagctcttttgagcaaggagctgaggcctcccaccagcagccacgtgaatgtgcgatgttggaagcagatcctccagccctggtccagtcttcagatgactgcagccccagccaacatcttgactagaacttgatgaaagagagatcctgagccagcaacacccagctaagcaactcccagattcacggctctcaaaatcatgagataatgaacatttgctgttttcagccgtgaagtcatgggggaatttgttatttatcaacagatatctaatatagttgggccacacttgcccagagccagtctctgcagccacatccaatccttattcatttattcactcagcaagtattttctttaatgccaacatttgtcaccacactctgtagctggatgctggggcattcgtggtgaatgaagctggcccaaatgctgctgtgatataaagggagatggatagaaaccacccgaaggaaacacattaacagcatttggcaaactgtggagaaaataaacagggacccataatcaagacaattggggtgatccctgcaaagggtgatcagaggcatttcagaggaggcaacatcagaggtgaaaccaaaaggataagaaagagccagaggtaagaagatctgggggaagggattcagggggaggaacagcaggtgttaaggccctggggagggatgcacactgtggctagaacataaagaccacatggggacagggcaacatgatgaaaaggaagaacaaacgagtggctgggtcccctcagaccaagtaggccaagcaaggagagtgggtgctatggtttggctgtgtcctccctccaatctcaaattacagctctcataatacccatgtgccatgggagggacctggtgggaggtaaataaatcatggtggcaggtcttatgttgttctcatgatagtgaataagtctcacaagatctgatggttttataaagaggcattcccctgcacatgctctctctcttgcctgccaccgtgtaagatgtgacattgctcctcctttgccttccaccatgattgtgaggcctccccagtcaagtggaactatgagtcaattaaacctctttcctttataaattagtctcagttatgtcttttttttgggggggtggggacggagtcttgctcttgtcacccaggctatagtgcagtggcacaatctcagctcactgcaatctccatctcccaggttcaagcaattctcctgcctcagcctcctgagtagctgggattacaggcacctgctaccatgtctggctaatttttgtacttttagtagagacagggttttgccatactgaccaggctggtctcgaactcctgacctcaggtgatccacctgcctcagcctcccaaagtactgggattacagtcatgagccactgcgcccggcctcaggtatgtctaataccttacttttgggagaggaagagacacccagtgtccctactgaacatgttcacctaggctggaacttggtttggtgacaatcttcaatgccttttactatctgtgaacaagggaagcagctctttgaagcactaactacaatcagtgccaggaaaggtctgagggaaggcagctgtggggataagaaacacccccttcctgcccctgcacccctttctccttgttagtgcccatctcacctgctgtagtcaactcttcatcgtaagggtctgggccagagctaccaccaccagcaagcttcctggctgacaggtggcttaggcacaggagaagggtctgaacaaggtacacttcatctctgcccagacttccagctctcagagagcaagaagtttatgttttcaaaagacagcatgtttttgacgttgcctgcaaagggtgtttaaaggaaataagagagatgtgaagagggctgggttagattggtcaagagaggagccttttcctgggtaatgacttcccaaacacgtgtgacaaatccacttagacatgagccagaggacatgttagaggaggctggaggggagaggcagttgtagagggtgagatgagagtttttaagctgaaactaaacattgtccaagcagtggccttttcatatccacatccctctttttccacatcccccatcgctaagccctgggaactgctcatttgtcatctatttctgtacttttgtcattttgagggtgttatagaaatggagcaatacggtacgtaaactgcagattggagcttttcactcagcataacctcctcgagattcatccaaattgttgcgtacatcaatagcttgctcctctctagtgctggagtggcattctgtggtaggaatgaactgcaatttgttgaaccgttcacccctgaaaggatgtctggcttgcttccagttcaggactattatgaataaagctgctgtgaattttcatgcacaggtttttgggtgaacataagtttccattctctgagataaatacctaagaatgcgttcactggatcatatggtccttgcatggttggttttgtaagaaactgacaaactattttccagagtgtttgcaccattttacattcctgccagccacataggagtgatccagtttcaccacatccttcagcatttggtgttgttaagggaggaggccactcctcatattgtcttatgcccaatttctgcctccaaagaaagaagaagtaaaaactaaaaggcagaaatgaaatccacaagcagacagcccagcaccacaccctgggcctggtaaagatagacccctgacctaatcggttatttgcataaaaaagcactgtgaagatccctgtcctgttctgttccgttctaattaacagtgtatgcgtcccctagtcacgtaccccctgcttgctcaatcagtcaggaccctctcatgcagacccccttagagttgtgagcccttaacaggacaggaactgctcactcaggtagctcagctcttgagacaggagtcttgccgatgctcccagccgaataaaccccttccttctttaactcggtgtctgaggagttttgtctgtggctcttcctgctacatagtcactatttttttattttagccactcagataggcaaatatatccatccaaataactctctcccagggctaattcctagagaaagtaaacaactggcctgcaagtctgcctttgatatgcaaaccaaaccattccctattccatgcccccacctgcttcctttcagcaggctcctgcagtctgggatattttctttcccctgccctaaatcaccccagggccaggtaccagacaactagagaccactcttgtatcctagcccatcagaataattcaaactacacactccgaagcctgctgtttgcttaccttaccttgcctatcacttcctctgaaaaccatgataaaggctcccacatacatttcctctctctctctctctgccccttcacccgccctcgtgcttccccgtgtggccctacatggcacactgcacctcctgcttctaggggtctttgagtagaaacttatttctttatgacagtcatttccgtatctgcatgccttaccatatctggttaaaacaaatcctggtacatttttttgttttgttttgagacagggtctcactgtgtcacccaggccacagtgtagtggtatgatcatagctcactgcagcctccatctcccaggctcaagcattcctcctgcctcagccttctgagaagctgggactacaggtgcgtgccaccatgcctggctaaattttttttttaagtaggcatgaagtcttgctatgttgcccaggctgagttcaagcaatcatcccgtctcagcctcccaaagtgttggcattagagatgggagccaccatgcccagcctcaggtacatttttaaacatgtcctcaatacattaacctggtccctgaaaaactcagaggggtcccatcatataacagtaaaccaacttaaactgaaccagttgatggcccaatcacagttttgttttgtttttgtttgtttgtagggagttccctacaatctactgtcaggaaaggaaaaaaatccaatatggtttatgagcagaagaacttgcaacagtatgatttcctctgtgcaggattcaaaaacaaccatgtccttgctcagcacactaaagcaagggagtgattactccaagaaatattcagatagtatttaaccctgacagtaggggaaagacagttatgaggtcagggagaggcatatggggggcttcaaacatcttaataatgattgatttcctaggctgaatggtgggtacacatgtttatttttagtccttgaactgtatagatacctcatatacatactcttgtgtatgggatgtattttatttatttatttgtttatctgagacagggtctccctctgtcacccaggctggagtgcagtggcacaatctcgactcaatgcaacctccacctccggggctcaagcgatcctcctgtctcagcttcccaagtagctgggatcacaggcatacaccaccacaccctgctaatttttgtatttttttgtagagatgaggtctgaccatgctgcccaggctgctctcaaactcctggactcaagtgatccacctgccttggcctcccaaagtgctgggattgcaggtgtaagccaccgcacccggcctacatttttttttaacttttaaaaagtatccggtgataagatggaaagaaatatgagggtcagggtcagaagtcctttttgcagtcagaggggctgtgtctctggacagggttccaatgggcatggggtgttgcaagttctcctgttcatgactctgtccaaggagtcctccaaggcctgttcacccagaggatagcaccgagtatgctcaggagcagaggcaccttcaggagtgggagaagcaggaagcaggtgctgctgggcagggacctgtgagacggagagagtgactagtagtaagctgccttctccggggagtcccaggctctgcctctcccccgccttccctcgaggtctcgtcctgtgccctcaaacccaatgtcagcatcaagcctggtgggtaccagggtcaggcagccccatgctgagggtcacaggctcctgaccttcattcagctcagaattaaccttgagtgtcaagacccaacagatgccggaggtgagggatagagaagaagagagatatgttaacccaggcaggaactggctcccagaaacaacttcctgaacagatccctcagccactgatgcccgcaggaactcagctcttgctgggaacaacctcaaggatgaaatactcctttacaaccatcttcactcaaattaaatatgatcacaagaacagctcttttgcttaaacggcttaacaatctcaaccccaaggagtgaactctccaagctcagcccatggccagtcgtctcgctccgtgggtcccactacactgctcccattccaactcctcagatgctgcattctctccccaaaatgggccgctgtgccatctctccaccttcccagccctctacctgcagggcttgtctgatgccctccctgatcctctctaagacgagtccctgtaacaaaccctgttggcgccctgccccatatcacctttgcccacttgagctcctggcagctgcaggcagtcttggccccaccaaggatttcccagctcaagctccccatctctgcctgaggttatctacaagagtgcacacattttcctgtgcagagcaggccagatgggccacagaattcatgcccccaggagtgcctgctgcctggaagactctgtctccagttctgaggaacgttctacacagtctctcatagggtgcccagaggggttaatctccagtgactccagttactacggggataaccccttcattacagcacatttcaccgcccttcccctttcctggtctcactttctgctctctcaatgtacttcttgagattacctctcaataaacaaattgctcctaagtccttgtctcaggacctgatttgggggaaacccaaactaagacagtccctttgttctttgtttctgtggaacatcttgtatttccttgatagcccaaatcatgccccaccagcttcccacacactctggcaccctatctctttacacctgctttattttcctccacagtaattatcattcgttgacatatttccttgatctatcgtctctctgtctctattacatatctctctctgccagctatcatctccatctgtctttccagtcagccagccagccatctctatcatctttcatatcatatctatcatctgtctgtttatctatctatccacctatctatctatctatctatctatctatctatccatctatctgtctgtccacctgtctgtctgtctatctatctatccatctggccattgcctgaatctacctatttgcaacttcctcaagagcacaatcttgcccctttgttcactgttgcatctctagaatctccatcagtttctggcgcataacaaataaacacctgttggccgagcacggtggctcacacctgtaatcccagcactttgggaggccgaggcgggcagatcacgaggtcaggagatcgagaccatcctggctaacatggtgaaacccccgtctctactaaaaatacaaaaaaaaaaattagccgggcctagtggcgggcgcctgtagtcccagctactcaggaggctgaggcaggagaatggcgtgaacccgggaggcggagtttgcagtgagccgagatcgtgccactgcagtccagcctcggcgatagagctagactctgtctcaaaaaataaataaataaataaatgttgagtgggtgaataatcaaggaaacctgtgtctaggaagccccaccctaggaaagaagctgcacacatggcaaaagacactgggacacgtgcattttacccttggcattggctgggcctggtgggagatgcaggtgtcttcacagagttctcagtactggaggctgaggataaagaacagaggttcagtgccctacgcctgactcttcccagctgagtacctggtacctgcatggttctgacttcataaagcagaggacgctcaaggaggcagctggacagatgttctaggaccatcgtcttccaataggcagaccaaagcctgactggagtaacagagcatccccccaaccccatcccaatggatgccctgctctggggccgggtgggcattttataaacccagaccagaggatgaccaccttctcccatgttggtgtcccccatctcgctgaaaatcaacatgccgaaggttaggcttaggttccaaaacccccatccttgccagtgtatccacacaccaccactaccctccagcacacactctctgtctcacacacactctcacacctgcacacacactctcacatgtgcactcacgcaacttcacaaatacactcacacgcccactcactcacacacgcctgctctcacacacactctcacatgcacactcacacacctgctctcacacacacacctgctctcacacacactcacacacacctgctctcacacacacccacacaccagctcttgcacacactcacacacttgctctcacacacactcacacactcacacacctgctctcacacacactcccacactcactcacacctgctctcacacactcacactcacacacacttgctccctcacacactcacacacactcacacacacctgctctctcacacattcacacacacctgctttcacacacaccttcacacctgcactcactctcacatgtttgcacacaactcacagtcacacactgaaacacacttacactgtcccactcattcaaacacacatgtatttcccacacacattcacacaacatactctgtcctgagtctctgatgcaccacactaggcccagttcttctctcctgggccaaaatttctgtggctgctctgcagagatggcctcagatgcctgagaaaagaggctcttacccgatgagaccagcacttgaacctggaagaagggatcgggcaggaaaccagacaggccatcttcctgcagtattgttgcaatcccacatcggtattttcctgcatcgtctgccgtgaggttctccaaggtcacggtgaaggtgaggtctccaggatggtccgtgatgatcacttggtcactcctcaccactccctcagaccctccggtctccaccatttcatgccaaattggcaagcatggttgtctgcaccagtatttgttaaacgtcttgtatttctcttcataccgacactgaacactcagggattcccccacggcgcccatcacggtgctggggccactcacagtcagacagcctggaaaacacaagtccgtttccccgtcttcacctggaagagtctggaccagtggaaccttgagtgtcaggtcctctgcacgcccagtgttgcctgaggctggaggagggaggagtcgggaaccagggagctatgggctatttgcagggggagacccaaggagatgcccggtgtgggatcctgagactccagaggccatgccagcctgggtgtgctcagccatcttataatatcagggggagaggcttgacctcggtggcctcagacaggttctgggtcccccagaagtgtcagtcctgagaagaaacacctgtcctcatcgaacaccaatgattgaatgaagccactaagtacactctgaataaatggatggctggagagatagatggatggatggatggatggatggatggatggatggacggatggatgaaataggaaaggaaataatattgagaaccaggaaaaaccagaagcagcccagtatggagggcaaggaggaagcctggggcttctggttctgcccctttcccaaatcatctgtgggcctcatacttgccatccctgcccatatagatgaggcctcctgctcccaggtctgggtcacagagaatatgggggctgcccatggggatatcaaggggccatgtagaaaggagttgttcttgtgattcaaggacatttacgcctggaattttcccccgggacagaatcctgcagcaacactcgccattgcctaacatctgcagggctccgctccacagggacacccatcagagcttccttcccacccccaattctctgcagcacccacccgccttggcatgtcctgggcctcttctccaggtcctctgccccctccaatatttcgacattactctccctcttcgagtcccctctctcattcctccacccactctgcaggctccgggtccaaatgattgggacccagccccatcaactctctgcttcctgcctcgggggcctcaccagtcctaaacagctgctgtctcatctgctcttgacagggaggtggttaactcaggacaaaacggctattgagaaatggttttggcaaaataccaagctcctgaaaaggaattgtggatgtaatctgtctacctatcaactatctatctatctatctatctatctatctatctatctatctactatctatccatccatccatctttcatctacccacccatccatctaggtaatatattgccatccactgatggagaggctttgctatatttttattgtgaattaaaagaaaaatctggccaggtgtggtggctcatgccgataatcccagcactttgggaggccgaggcaggtggatcacctgaggtcaggagtttgagaccagcctaaccaacacgatgaaaccctgtccctatcgaaaatacaaaaaattagccgggcgtggtggtgggtgcctgtaatccagctactcaggaggctgagggaggagaatcacttgaacccaggaggtggaggttgcagtgagccgagatcgcaccactgcactccagcctgggcgacagagtgagactctgtctcaaaaaaaaaacaggaaaactttatcttttgcatcttcattttcttatctcacgttttctcactttatttcccagaaagcaggctcgagtggcccactgacctattctgcattagaaagctgtctgcctctctgaagcagtgattctcacctggggggcaggggggcggggagggggcgggggggcaggggggcgggcgggagaacatttggtaatgactacagatatttttggttgtcccaacttagggtggggaattgctgctggcatctggtgggtagaggccagggatgcttctaaacatcttacaatgcacaggacagcccccaacacacagaataacgcagccccaaatgtccacagtgttgaggtccacgagctttcccagggagctaactgcctgccaggcacaggcttaggagcaaggaaggggtgggcacacccagtcctctcctgaaatcgctgctgctctcagctcaggctctgggggcgctgttagcctgctctttcaggtccttaaacttctctcttaatgatttggggctaattccacaaggagcaaaaacattgtggggcacacactgaatcccaccacagagcctccctctccttggatattcagtccagaccctgactctgagccaacatgggcagcctcctccacctccacccccaccatcttttacggagcttcccgcctacccagccttgcaaagaaactgactttctccctccaccatcatttacggaaactctcggaccagggctgaccacaggttcccagctgtctcacccttctgggggcccattaagtagcagccctggggccagcccagacctgtggggacacccagggttcccacgtggggatgcagcatatgcctccagatatgtaagtgaagctttacaaggaggcgcagcagacattgacattgaattagagaaggagcaatgatcttggaaataaaagtatttaggtttggaccttgactgtgccttttataaactgtttaatctaaattatttgcacctctaagagcgagcttcggtctcttgttttcatcaggattgcaataagaattaaatgagatagtgggaaacaagatatgtattacagtgattagcctagtaagtactggttttctgtcccctattcccccttctctctgatggatcgtggtggcattcctgatcttaataatgacggtaataatgattaaagttgccaaatctacttagggcttactgtgtgggaagcagtttaccgtttaatccccaccctatcccgataaggagatttgagaagcttctatgcacacctcactccctctttcttgatatcatttcttcctcttgcccctcgccagccttttctcatgcctgcctcaccctgacccgccagagcagacctccctgcacccaggacctgccctgctcatctgggacacagagaaggagcagagctgaaggcagcatggcagccccagccctctgggtcatctcaccagcatggaagtcccttgtggcagcagggtctgaggctctttttccttctcacatctctcgtttccttctctggcctcttctgggtttggttctcagagctggtgagagtatggaggaagctggggccatggggcactatgtggtcaggtgaaacaattttgagaacttgctgaagttcttcctaataaaacatgtttgcatttgctgttcctctttctgttcccagtaaagacaatgtccctcccattacccacagctgacaggcctgcccttctccaaatcacagcatggcccaggaccagtgagactgggccagctgccatctggattttctgggcaggtcctcccctctgtgaatggccagttttctgtggccagcatgagccgccccagggtatggctcagccttcactggatggatgagactggctatttgcagagcccagtgtaaaatcaaacctaggtttccaaaattattaagaatttcaagatggtgacagccaagcatgaaacgtgggacccttctaagagccgggcctgcgagactgcacagggtaggggcacacccacgatgcccgctggtctatctctgatccttggtggtacagataggctgggtgcaacctcagaggctctgacctcttaacccctcactcttgctctgacctcagcagaccccagaggtccctgtcttggccacgtgcctgactgtttccacagacctggcaccacgcagagcttggtggaccatctataagccttgcttttgacctgtgtggctcttcctgtcgcccaagatgaccacatataagagtttcaatatatcaagagctaactcgggggaacctggccagaagtgtgcctgatatacacagaatggctgtggaggatttataaatgcaagcacagcttcagaaggcctcactcagggacttagatttctggaactaggagactccaaattcctggcattctgttatcaaatgtctcctccttggtgtttcagtaaatgtgtttcctgcttgttcattttttgctgcatgtggagtcctcatatttctgtgtgtgttcacatgtgtgtatatgggtgtggtatgagggatatatgtgtagtgtgtgtggtgtgggtagtgtgtgtagtatgtgtggtatgtgtgtatgtaggtacatgtgatgtatgtgcatggtgtgtgggatggtgtgtgtgtagtgtgtgtgtatgtgtggtgtgagtggtgtgtgtgagatgtgtgtagtgtgtgtgtatgtgtgtggtgtttggggtcgtgtgtgtggtgtgagtggtgtgtgtggtgtgggtgggatgtgtgtagtgtgtgtatgtgtgtacatgtggtgtatgtgtgtgatgtgtggggtggggtgcatgtagtgtgtgtgtttgcatgtgtgtgtggtgtgtgtgcacaggtggtgtgtgtgtagtgtgtatgtgtgtgcacgtgtgtggtgtgagatgtgtgtacatgtggtgtatatgtacagtatgtggggtagggtgtgtgtaatgtgtgtgtggtgtgtgtgatgtgagtggtgtgtatgagatgagatgtgtgtagtgtgtatgtgtgtacgtgtgtgtggtgtgttgggtggtgtgtgtagtgtgtatatgtgtgcatgtgtgggagtgtatgtggtgtgtgcgtgtccatgtgtggtgtacgtgtgtggtatgtggggtggtgtgtggtgtatgtgtgtggtatgtggggtgatgtgtgtagtgtatgtatgtgtgtgcatgtgtgggcgtggagggtgtgggtggtgtgtgtgtacatgtggtgtatgtgtgtggtgtgtgtatgtgtgtgcatgtgtggggggtgtgggtggtgtgtgtctacatgtggcgtatgtgtgtggtgtgtggggtggtgtgtgcatgtgtgggcgtggggaggtgtatgggtgtgtgtgtgtgtacatgtggtgtatatgtgtggtgtgtgggttggtgcgtgcatgtgtgtggaggggaagcaggagctgggagtgataaagatgtctccccttgcagcctgcagagccggttgcgagccccgccctctgtgcctagctctgggcgctaaggaaaggcttgcctggccctccctgactctgcgtcaagggctgctcaacgtgcctttcttgggaagaagggatctgagtctgtgaaggagatgacgcacagctgcagacttttccagaaaacattctcgccatccttgtctggacaaaccaccgggtgcacagggttgtattagtcagctctttctggctcacattgccatagcaaaactcctaatcccagcatgctgtaaccacagaagcttgtttctcgctcgtctatacgcaagcggtgagtcagcattgcttgggcaccaggctgcggagcccagtccgctagaggagagggaaggcaccgggtggctctctgagcctctgctcagaaggcgcacatgcggctcctgctcaccgttcatcgtcatagggtcaagcctgaagtcagtgggaaggagaagcacagtcctcttacaggacaaggcggcaagtcactgaccacaaccacagaacccactactggaggttccctaaccgggctggaagggtgccccgcagcacaccgactccgtgcttctcgctcatccaaggtcggggcagggagaggctgcagggtctgcttagaaacagcctgtgtgtgtttcatttttttagctaggaccagacagtttgccaaatgcaaaggacatggcaatgccacagggaacccacctttgaagcagatgtactctgggccctggagtcccccaggagatgacaaattccttgaagagatgacccacatctgggacatccaggctttttccatgtcaaggccagcatctggagccgctgtcccttccccagcaggcccttgtccttctgtctctgaaacctgtcctggaaaatgctgtccgctccaggagggcagagctaggggaggactgagaataatgaacactggccatgaggcacaggagggcggggagcccggggccctgcctggcactgcaccacactgagacccccaccatcgctgcccttgagggacagctcttggggcttccagaaagttaagatctcatcagtgaggggtgcgttcttagggcaaactcggggcatgtgatgtgtaggacagtgtgagtagcccacacatttctctctgcctttcggggctgtgcttgtctttctgcttcctcgaaaaccgtcatcctcccttctcactctcccaggatgagctcagaccacacctctcctggaaggcatccctgcctgctccaggccttccagacccctccctctggggttcctgttacctgcaatgcttatttctgtatttaatctcatgtccctgtgctgtcattgtcctgttgcatggcatccatttccaggtgaggctgtagcctccacaaaggcaggaccaatctgggcacccggagacgcagacagagctcggccccagccttgtgagctgaattggagggtgagagctccgatccttccatattttccaggggaggggatcaggaatgtattaaggcattgggcctctcttctctcacctctactacccgacgtcaatccatttggggagtagttctcagtatcttgtgcatcatggtgagaatgggcaagtgcccaaggatggtggaccccactgcccactttcttccctccccactggcactcaagggagacgtcaccaagagggcagcctcctgaccggctctgggcaatggatgcctctttgggatcttgttacaaatacagggctctctagggagcagggtgtggggagggtcttcccaacatgggggctggggtgctatagggagcccggctcagagagggtctctacctgactctgatgatgtgggccatgtagcacagtgaggaaggttctggccataagctgggagccctggctcagattttaaggtctgctgttcactagttatatgactttaggcaaatcagcaaaagtctcttagcatcagtctcctcatctgtgaaataggaataaaaatattcaccctgctcagtcccaggagttgagcaaaggcatttgaaggtggtggcatccctctgggaaactttcctcttttgatcttctacgtaccatgcactctgtatatttaaatcctgcatacccatcccaacacccctgccaggtcacttttaaataagatgactggagctggaaagacgaactaaactgtcatgatgggaagtggggaggtcaggatttgaacccaggtcttcggtggggtcccacctctggctctcatgatgcaaggtacggattgcaacactcaggcaggggtgagatgggttgagagatggcaagtggaagaggcctccaagtcttatttcattcaatatctgtttgcagaatagcaggaagtatcttcaggggaaattaacaacacaacaaagtctgcttctgggtgtctgctatggattgatgagttcccccaaaaattcatatgtggaagccctaacccgtaatgtggtgatattaggaaatgagcctgtgggaggtaattagggttagatgaggtcatgaggatcaggccttcattgtgggattagtgcccttatcagaagaagaagagagatctcactttctttcttagtccatttaggctgctattttaaaataccatagactgggtgggttatgaacaacagaaatgcattactcacagttgtggaggctggaaagtccaagatcaaagtgctagcagattcagtgtctgttgcgcactcaccttctggttcataaagagtacttttttttgctgtgtcttcacatggtggaaggggcaagacagctctctggggtctcttttacaagggtactaatcctgttcataagggttacacccccacaactgaattatccccaaggatccacctcctaataccaacacactgggaataagtttcaacacatgaattctggagaaacacaaacactcagaccatagcactctctctgccatacgaggatacagaaagatggcagccatctgcaagtcaagaagagagtcctcaccaaacaccaaatctaccaacatcttgatcttgacttcccagccttcagaactataataaataaaggtcccttgtttataaaccactcggtttatggtattttgttacagcagcctgagctgactgagacaacgtcctggtgtctgtcccaatgcttcaccgttctggcttttcagcatgagtcacctgtgctccttctccctggaggagccctgtctggggcaagacctttgcagaaacagtgaggcttcttgtcactttcctcatttggaaatcagggatttggatgacaactggattccaccaactgaggtgtctctgaggccatttgaaaggcccagttagacagaggttatcttccacagctcttagccactgctgttggcaaacaaggattagaagaaacaggagactttcatgaagcagagttccaggatatgttttctagcttcctgggtgacaagaagcagtgagggcagtgacaacttcttcatctgacttccattaggaagattccttggattgcagcttcataaaattattctctagcttcctggatgtggaaggcagttgcttggcagataccaagacttcatgctccctgtttgaccctaggggcctcaaaagcaggctgttctggatgtgagggaggagggagggacaagcttaggagctgcttcttcggccctttccacaatattataagcacctaattctctgcataccttctagtgcccacctagaatgggcactagacctgagtggatacatactcttggaaggatccaatcccagcaataaggttgttattaactaagataaaggaaacccacattatacagctcctcctgtctctgggtcaagggagagcgggcaggcaggagagtcatcttagaaccgcatgccatgtgttctcattccatccagcaggtgacttgtgccaggcactgctatctacactggtgaacaagactgaggccctgcagggtcctgatgggtactagaggctctggttccaatatgaggaggatgaacacttcagcacagttgtctttttagtagacggaccaggaaatcagaggagctctctgttactccataagggctgtggttctcagtaataactaatggctgttgttctcaataataactaatggctgtggttctcaataataactaatggctgtggttctcagtaataactaatggctgtggttctcagtaataactaatggctgtggttctcagtaataactaatggctgtggttctcagtaataactaatggctgtggttctcagtaataactaatggctgaggttctcagtaataactaatggctgtggttcttagtaataactaatggctgtggttctcaataataactaatggttgtggttctcagtaataactaatggttgtggttctcaataataactaatggctgtggttctcagtaataactaatggctgtggttctcagtaataactaatggctgaggttctcagtaatgaccaaaatccagcagcaatgcattatagtcaatggtagaacactgctgcattttggtcattccttgaaacccatttgcttgaaactcagttctgctacaattgcagggatgtatgcaggaaaaatattaactcagcaggcttaggttgtccaaagcctgcaccttcccgaaaaaagtttagcccttgctttgcttctaggagataagctctaaacccttggaatatcctgcctggttagattgtctttttttatctgggggctttgatgccatgctggatagctcatgttaaccatgtgattatggtgggggcttctagccatgctagatggttgatgctatcaatgtaattcatgggtgggtagggggaactttgagctatgtagttttaatttgatctctggcgacttaggcactgaggtcagttctacaggtgttccatgactatgtgactgaccccagtgaactctctggataccaaggcttgggtgagcatccctggatggagcactttgtgtgtgttgtcacacattgttgctaggatgggagaattaaacactgtctgcaaaatcccactgggagaggacagctggcagcttgcaccacgcactttttacctttactggttttaatccatatcctttcagtgtaataaaccataaccatgcatataacagcttttctgagttctgagtccttctagtgtagccgagtccaaagctcaaactgcttgccaagcaacagccagtaagtcgagagacaagctgttggggcaaggaagatggctttacaaggcagcaaaccaaagagatggtggactcatgtcctaaagagcaatcataaaaggcatgaacctcaagcttctttttatattggggaaggcagaacaaggaggaggttgagccgggtagtgacaggtgaccacagacatctgggtgtcagctgaggaggttgcattaacttctttgttcttggtcaggtcacaatgctcctataaatcgttagcataacattgttactgtgtgtatgtcttccttattgcttcaggggtgttgcaaagggactattatcatccttgctttaaagtgaaactatagccaggtgtgatggctcatgcctgtaatcccagcaatttgggaggccaaggcaggcagatcacctgaggtcaggagttcgagaccagcctggccaacagggtgaaaccttgtctctactaaaaatacaaaagttagccgggtgtggtggtgcacacctgtagtcccacctagtcaggaggctgaggcaggagaattgcttgaactcaggaggcagaggttgcagtgagccgagatcgcgccactgcactccagcctgagcaacagagcgagactctatctcaaaaaaaaaaaagaaagaaagaaagaaaagaaaaaaagttaaactatacactaaattcctcccacagttagtttgggttatatgctaaagatattgcagggtaggggtgtggtcaggagcaaaatggagtttgttattctagacctccttttcatggttatgctagtgaatcattaaacctgggagtggtattgggtacccccaataagagatggaaagtttgactgaattttagtgcaatatgataacagaggggagagccacctgttgtgatgatagggaagcggggtaaggtaccatcaagctagcttccagtgaaaaagagtgtttacccaggagtactaggtcccacaggtacaggagggagtacggcaaatgaggtgagaaattctactcaaatagtggccaggcacagtggctcatgcctgtaatcattgcactttgggaggccaaggcaggccaatcacctgaggtcaggagttcgagaccagccttgccaacatgatgaaaccccatctctactaaaaatacaaaaaattagctgagcgtggtggtgcacatctgtaatcccagctactcgggaggctgaggcaggagaaccgcttgaacccgggagttggaggttgcaatgagccgagatcatgccgctacactccagcctgggcgacagattgagactctgtctcaaagaaaaaaaaaaaagaaaaagaaaaagaaaaagaaaagaaattctactcaaatagtgatcttgttgggaagatgtccaagttaattcagttacagagatcaacatcatatatctttcatttcattagacttgtcaacatctttccaaggaaattgcttttggatttgtcatggatattcgattttgctttatttgtttgctatcatttttgtaattagtttctgctacattagaccctttatccatcaataccacagtgtttattcaaatatattcccactacatgtctatgaatgttattgattattgagtattgactagagaaagaatctcttatatgggtagcaagaacagagaagttagcttatagaaagaattaaatcagtaaatttagacgcaattgtgcaaattagctagtcttgacaggaaagagaaactttgagatattcgacaaaataagaaaggaaaatggcagaatgagaatcgatttgcattctttcaaccataagaatgaggatgttgatctggttaactgcctcttgctagtagatctggggaggaattggaaagacaaagattgaggtcgtgaaggggaagaataagacaagtaaagcacagtcacgttgagctgctggttttggtgacctatggctccccggcggctgtgattggagtctgaagctgagaagtcatgaggctaaatgtcccgattgtcttgccaagctgcttagaccttgccacttagaccttgttgcttagaaggagacaccagaaaccaggaacttgaggctgggataaagcagatgctttctctcctggtgctctgggaagggagtttgaagtaatctaggcagcttgctgcttgtgccttcatcctggcgggcaaaatcaccttgagtggaggtagaacacgtgtatctgccaaactgtgattctctaagggcaaggattacatctctgtttttttgtttgtttgttggtttttgagacggagtcaggctagagtgcagtggcgccatcttggctcactgcaagctctgcctcccgggttcacgccattctcctgcctcagcctcccaagtagctgggactacaggcgcccgccaccacgtcctgctaattttttgtatttttagtagagacggggtttcaccgtgttagccaggatggtcttgatctcctgacctcgtgacccgcccgcctcggcctcccaaagtgctgggattacaggcgtgagccaccgcgcccggcccccaaaaggaaactcttgatttgacctcctgcaaactccccagcctgatcctcttctcatcacagtaaattacacccatggtcccctttttctcagaccaaactccagtcacctgggcaacatccttggctcatcttttgctcgtgccccagccattgtgttaacccaagaccctcagatctgtccacttttctccattgccctcccacccccctctttctccctgattaccacagggccttccctcttgaacaggcacaagagctccccagtctgactcttgtccctattcactgtggctagattgcacttttaaaaacagttaccagaggcggggcgggtggatcacctgaggtcaggagtttgagaccagcctgatcaatatgttgaaaccccgtctctgctaaaaatacaaaaattaactgggcgtggtggcatgtgcctgtattcccagctactcgggaagctgaagcaggagaattgcttgaagccaggatgcagaggttgcagtgagccaagatcgcgccactgcactcccgcctgggtgacagaacgaggctccgtctcaaaaaaaaaaaaaacaagcaaacaaaaaaaccaacaatgaatatcatcaatacaaaaaccaccatactgacaatattagtacggggaagaggatggtgggaaaagaggaagatacagaagtcctcatcttttgctgcagagagtcaatagaaagattcaataatgttgttaaaaacaagatgagaacgtgggagctcagagagtgttatgagttggtggggtgtccacactgggtgggggctgggagcagcgctggtcagagcctgggcagcagacaggacatgggtcagcccagagaggggcggcagagctcatgaagggtgaggctgggggtgggggagtctggataataaccatgatttcatcattttctagctgagtgatcctttatctttgagcctgtagactgccttcacggcacttacccaggtctttttctttatttcggtgatagttgtacttgaacagtgcctgatacttagtggatgcttagtaaatgttttcgcttattttttatttttatttatgtattttttgtgacagagtctccctcaatcacccaggctggagtgcagtggtgcaatctggacttactgcaacctccacctcccaggctcaagagattctcatgtctcagcctcccaagtagctgggattataggtgtgcgccaccatacccagctaagttttgtacttttagtagagatggggtttcaccatgttggccaggatggtctcaaagtcctggcctcaagtgatctacccacctcggcctcccaaagttctgggattacaggagtgagccactgcgcccagcattttggaatgaatgatggtggggagtgaataagggtctcacctgggtacagagattgacctgacagagggcagttgggtgatcctggttcatgttcccagaagggaatttctgttatttagcctctgtcttaaccaccagatgatcccactgggcagggggctcagtcattagagtccaagactgagcaccaccctggggacccaggcaggcggtactgaggacccagccatccccagctcacagttctagctctggcatccagtttatggattatgtcacagtccccaaaatgtatgggtgatctccccatataccccaaattgagagtagcagccaactgcaatactcttaaaagaggtaagaaaatgtaacaatcaacactaatagaaaagtcttacagtgacgaaaggaggctgtgttttcccatcatcttcaatcgtactcatccaggaatctcctgacttcccttccccacaagtggcaggagagcagctggcacggcagcccggaaacctctgctctcttctgtactcatcttcccttaagttggcccattaccagagtttggttccgtttttctgttttcatgggtttaggattttgaaacccattattgactggagacttgaaccccacggaatgcaaagacaggtccgttaacattgcatgtggctcacagacctgagatcacgaatgtccactacggcataggtgcctctcgggggaaacacattcttctcatgttttctactgcattggagacctcagaaggaagaagggctctgtcaggccccagggactgtgcagagaagggaatagccccaggtggcacggctgcaggagataggggactaggaggctgttccctgaagctggggccagcactgcctctagaaccacagtcaattccccatagaaatgttgtttttctgccaggtgcggtggctcacacctgtaatcccaccactttgggaggcgaagcgggaggatctcttgaggtcaagagttcgagaccagcctgggcaacgtggtggaagcccatctctacaaaaaaatttaaaaattagctgggggtggtggcatgtgcctgtagccccagctactctggaggttgaggcaggaggatcgcttgagcctgggaggggaaagttgcagtgagcagagattacaccattgcattccagcctgggtgacagagcaagactctatctctagaaagaaaaaaagaagagaaaagaaaatgttttttcttctgtgggagggcctttcgccctggacaggacgtcaatgggcattgggactctcatcatcgggctgactcctcctccttcaagaccttctttgtggtctgtttacccagaggacggtccccagcatgctcaggagcagaggcagctccaggaggaacaggaacaggaagtgggtgctcttgagcggggacctgtgggaacacggtgacaggaaatgagctgcctcctgggtcagaggtctcaggtcttctcagctctatgcccagatcctggcttccaatgtctatgtgagggtaagcctggaaccccagacaggccagcccctttggtggggcacagtcacactgctcaccagcgaggctcccagtcctccctacacctccagtaaactcagcctggcattcaaggtcccgtctgccaactcccatccggcctttttggctggtctcccataactcctcctcacctatcttgaaggggtttagcattccctgtctctacttacctcggcttctgctgcattctgcacccagagggcctctccgccctcatcgctgcctgtgcaaacgctacccacctttcaggtatcagatctgacatcatattcttgaaggccttggaggctgaccttgctctgaccctcttcctgtggaccagcacctggccctggggttccttatgttccctgttactttctatggatgtgtaaggcccagaaccttattgaccatcaattccaccccctcaccatcctccacccacttcccagggtctcgacctcccaacttgggccttcgttgtttctttcacctcagcgcaacttgaagccactctcagctcacggataaattttaaaaatcaggccaggcgtggtggttcgcacgtgtaatcccagcactttgggaggccaaggcaggtggattgcttgagcccaagagttcaagaccagcctgggcaacatattgaggccccatctctaaaaaaaaaaaaaaaaaagacagaaaagaaaattcaaaattatatccaactccagaatgccggatgagccctcagatgatgggactgagggtatttgggggagatggaggaggggctatacagcaggccacgggtcaaaatgcccccaaaggtccttcccagcatcttcactcttggggctctcctgctacacctctggagtcctttgccctctgtcccctgacagctaaagtcccatcagtttgcacaaaagcatggaggaggaaaaaaacaaacaaaaaaaaaacagtcgaggagtcctaaagccagctccgtgggtggagctctgcagatgcattctcagaactcaagatcgagtgaataaaaaaaaaaaaacagagttgaactgcagagggaactggcagaccttgaggagtagttccaggaggactgagccagagacacgggcctctgcgctgggctctagcaggagcaggacggtctgtggtttgggctctggccttgacctggggggcttgaccacagcaggccgtgatggaacccaacggctagctatcaggtgccgacctctggggactcctctggacacctccagggctggtgagcatcagactaatcctccagacccctctgccagcttgggagggtgagaacgccaaacttccagcttccccctttccctctagcattttccattcccctactctggtgtcttgggagagagaggctggaacaatatttgttcttgggcagaaactaggagcagatgagagaggtgtctctcctaacccactaaaggccaaacctcgatatgccctcttgaccccaggaggtggggagggcatgttcaggcccctctcctgccaccttcagtcatgtggtggctcatgtctgtgctgcagagtttgccttcatgtagccaacacttagatgggaaatcttattttcctcaaaggtaaactgagattggggcaggccatcggaggtttgcagtgactttactgatacaaagacgaaacagcaggggcctatgggggtcccagcctgagtacccccagaaaacagggctatcagagttaacaaataaaagcatagaatgctcagttaaatttgaagttcagataaacaacatatgcttttttagtataagtatagcccatgaaatagttgggatatacttatgctaaaaaatgttttgttgtttgtctgaaattgcagtgtaactgggcatgctattgttgtatctggcaacccctgttagaggagaggccatggggccaggcctgtgcgaaagtggtgggacctggctccacctacctggtgagggggctgctggtcttctgggtggctgcagctgtgaaagccaggcttgctgttgtggttgtccattctgagactgcagtttgtgtgcctaaacatacaaagcagaacacggttcaccccttccatggatggcccagctctggctgtggccctaaggcttctccacctaggaattaaggagcctctgccttggggtccaagactgtctggtcagcatccaaaatattacatgaattatcttctaaagagaagttactgaattattaccatgtgagaaattctgaggagcagactaaggagggaatttgcaatcatcagttgcatggcacagcttagcacactcgatagcattccgctctcctcgggctaggctagctcttttctgagtctcggccacagccgaggtgaactccttaccgcctgttctggagtgattcggcggctgagctggtggccccctcgctgagccacttctggagagccccggattcctggctctctgcagccaggcccagcgccctccacctccgctcttccctctctggccgtttcctgtcttccagcagcttcccaatctcaccctccctacccctgttgaagtctggctatgtctgatgcatcccagcctctgctgtgtgccaattcctgctggaccacaccctactcacgctgacggtgtgtgtagtgagttttgatattcaaagtttgcttcaggagcaatctaataataagagatcacagcatcatatttgtctttttatatcatttttctgggattaaatcaaggtataactgacacataataaactgtaaatatttaaagagaacaatatgttaaactctgatgtatgtgtatacccggtaacaccaccaccatgatcaggacagtcaacacattcataatccccatgcccgccctcccccttactctgtccccaggtgttagggactgaactgtggacccctaaaaattatatgttgatatgctagtccccagtacctcaaaatgtgactatatttggagataggacctttcaagaggcaattaagttaaaatgagtttgttagggtaagtcctaatgccatctgactggtatcgttctctgaagaggagatgaggacacacagggagacaccaaggcatgcgagcacagaggggcaaccgcaagaaggggtagcaagaaggcagccacctgcaagccagggagggaggcctcaggctcaactgaacctgccaacaccttgatctcggacttccagcctccagaactatgagaaatacgtttctgttgtttacgccacccagtctgtggtattttgttgtgacagccttagctaagggatgatccattttctcttactatctatgagttggcattttccagaatctaatataaatggaatcatacagtgtaaatcagcttttgagctggtttctttcactcagcataactattttatcattggtatatcagtagaacattcccttttattgcaagttgtattccattgcatgagtatttcactttttttttttttttttttttgagacagagtctctctctgtcactcaggttgcagtgcagtggcatgatcttggctcactgcaaccactgcctcccaggttcaagcaattctctgcctcaccctcccaagcatctgggactacaggttagtgccaccatagccagctaatttttttttatttttagtagagatggggttttgtcatgttggctaggctggtctcaaactcctagcctcaagtgatccacctgcctcagccttaacaaagtgctgggattacaggcgtgaaccaccacgcccagcctgtatttcacatttttaaaaaaatccactcacttgaattgtttccagttttttgctattacaaataaagctgctatgaacattcacatacaggtctctgtgtgaacataaaactttctattattttgactaaatatggaagtgctgaggggctggatcatctctggcgggcatacatttcatgtctgaagaaactgcaaactcttttcccaggtggttgcatcatgtgcattcccacctgcagggtatgagggctccaggtactcgagagtgtttccaacacttggtgtcaaggtcagtaatgttaacttttgttacaggccgaaagaatgagagtcatgaccaacacagtatagcactggaggctatatgagcgaacagaaaactgttctcatgaaagcaggatgttggaaaactggcaacggtgtctgctgcccgaaggggtgctgagggcagtcacaccccaagtgctgtgttccttgtgattatctataggaacatctgaagcctgttgtacaaagaaagctattgtgtgtacctgtaataaatcaagcagctgaccaaccattacctctccctcccttctctttctacctaataaatacgaagggctgtagaagctcagggcccttgttcactagaagcaaggagctccctgaccccttctttcaaaacagatctctttgtctttgtcttcatttctgcattcgtcccccctttgttcaatcccctagcaaccaacagcgacaagtggtggccgggacaggaacgtgagcaaagaaggtctgctggagcagagaaagagaaactgacaagacgaacgagaaaccctggaacaagtctgccggcagccaataaaaggtcagtgccctaaagaggtactgggagcggcagcagatacaagatcagtgccctaaagaggtactgggatatcaggtcagtgccctagagaggtactgggaatgggaagttttctgaataagggtaacatggggcagaatttgtctattgaggtgcaacattatgtgcatttgcttaaagttttacttaaacaaactggtgctcaggttagttctcaaacattaattaagatgctgaagaaggtcactatacataacccgtggtttccacagacaggcagtcttgatgtagaaatttgggacagagtaggaccaggattaaaacgggctcaccaaaaaggtcttaaatttgatctttttgttttttctgcttggagtttagtccgtgctgtcctcctgccattatcttcttcttattctgctagacagcaggaatcatattccaagtctaaaaatctgaaaaaatattttgtcccacccacagtaccaattaaaaataataaacaggagaaggaggatgaaaactggcctgtgtcaccccctccagtagcagaaacgtctgtactgcctccttcagtagcagaaatagagaccccaatacaaagaattttatgctctgctgctatagctggaaagcccttaggaccttgcgcttttcctatttccataaggcccgatccaaataatcctcagcagtttattcatgaacacaccccactacagtttaagttgctgaaggaattgaaagcgagtgtagttaataatggagtacaaagcccatttactttaggattgctagaatctatatttggtgctatgcgccttccaccctttgatgtaaagcatttggcttgcacttgtttgtctgctagtgcatacctgacatggaatttaaattggcaagaactgtgtgcagaccaggctagacagaatcatgctgctggacacggagacattacagaggatatgctgttaggtaatcgtccttattcagacctggaacatcacatggcactcccagacactgcttataagcagtgtgccttggctgctaaacatgcctgggccacaattcctgaggaaggggtcccagtacaatcttttttacatatcatgtaagggtggccaatgcacattttcttgcaagattacaagaggcggtgaagcatcagattcctcatactgcggctacagaaatgctaaccttaactctagcttttgagaatgcaaatgcagattgtaaatgtgcactggcatctgtgagatgtacaaaaaactcgggaaattttctcaaagcttgtcaagatgtgggaactgaacttcattgctctacaatgttggctcaagcaatggctaatttagtagtggacaaatctaaaaacggccaaggagcaaatcctaaaatgggaaaatgttataattgtggaaaaatcggacacttcaaaaaagaataccgtcagacctttgggcagaagggatcttataatgcagccccccaccccagaaaaaatgccaggactttgccctcattgcaatataggaaataactgggctagtcaatgccactcaaaatttcatcagaatggcacccccctgtcgggaaacgagaagggggcctggacccgggccctataaacaatggaggcattccctgtccagcccacagccccatctcagggataggttcccggaggcacattgattccctctccccaggaacacctggaagctcaggattcgatctcccagtcagagaacaggtaacgttagtgggaggagacaaacccaccaagattcccactggtatttggggacctttgccaacaggatatatgggattaattttgggtaaaagctgtcttaatttacagagcattaccttagtcccaggagttattgattctgattatgaaggagaaattcaagtagtggtaatgtcacaaggtctttgggtttttgaaccaggagaatatattgctcagctactgcttattacctgccagttacacccttctttacggaggttgggagttcgagaccagcctgaccaacatggagaaaccctgtctctactaaaaatacaaaattagctgggcatggtggtgcatgcctgtaatcccagctactcgggaggctaaggcaagagaatctctggaacccaggaggtggaggttgtggtgagccgagatcgtgccattgcactccagcccaggcaacaagagcgaaactccatctcaaaaaaaaaaaaattgatattatccggtcctgaactcaccaaagggccatctgagcctgaaattttcttcgtgagaagatggcaaatgacaaattctatttcattaaaagatatagagctattccagttatctatttcttcttgtgactggtagtttgtgcctttcaaggatgtttttccatttcatttaacttgttgaatatattggcataaaagttgtttacgacacatattcccttattattcttttagtagctataaaatctgttgtaatgttacctctctcatttctgatgttagtaatttatatctttttcctgatcagtctaggtagaggtttaacagtgtttctgatgttttcacagaaaacatatctcatttcattgatttttccctattacttttgttttcgatttcattaatttttcattgtggtcttaatattatctgtgttctgatgtttgctttgagtttactttgatcttttttttccctagtatcttgagctaaggccattgacttgaggcccttctccttttctgatacagggacttagtgctataaagaagttccaagaaggcactggcagggattggggtctctggttaccagggaagggggtccctttggcctgtgggctgaaactggaaccatcaccctgtcatctgtgggcaacagactcaggcactgagctgtgcagagaaaaaaaaaatgtgcctagaaagacttaatcccatcctggagggagccctgggagccatggggtcattaagagatcccctcaatcccaagcggtccttcagggtcctatgagacctgtcttagtctactttttcttgcttataacagaatatctggaattgagtcatttataaggaaaaggaatttgtttcttacagttatggaggctaagatgtccgaggttgaggagccacatcttgtgagggccttcttgatggcagggactctctgcagagtcccaaggtggctccaggcacctcgtggtggcggaactgagtatgctaagtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccagaagaatgattgctgccttgatgcttggctgttcctagtggttctaatggtttctggtggctctgctgtagttaatcaccctgaatgaatccctttgaaatcaaccaaatagtgatgccaactggtctctatctgctatgggatccacatcacacagatctccatttcgccatacagtgttataaattccacttccaaaattcctaggaaaagctaacttttaagataaacacaagtaaaggttaggtataaacagagcagcacccattcaacacccttctgcatcttataagttcttctctaaacataatggacatgattcaagtcagttaaagggtgaggaacgggcatacctaattagctccacttttcaaacaatttgatccaggacaagactagtctccatgaacttgtcagcctaatctttcacttgaaaacaattcaaaacagtggaaataccttaagtgagagctttgccagaaattctttaaattcaactgacctaaagggagacccatctaaagaaacgattgattttgatgatttatgcactggcaataaaccatagctgtgattagtgcagcataaacttgagatggaactagaagcacattggagcacttgaagaagccctgggggcaattcctgtggcaggagagaggttgtctctgaaacgccaagagacacccaaggtcgtgggtaagagctcaggctgtgccagagtgcttgggtttgaatcctggctctaccactgataagttttgtgaacctgggcaaattaacctctctgtgtgatacggtttgtctgtgtcctcacccaaatctcatcttgaattgtagctcccataatttccacatgttgtggggggcaccagttgggagttaattgaatcatggggcggtttcccccacattgttctcgtggtagtgaataagtctcatgagagctgatggttttataatgggaaacctctttcacttggctctcattctctctcttgcctgctgccatataatacatgcctttcaccttccaccatgattgtgaggcctccccagtcatgtggaactgtgagtccattaaacctctttttctgtgtaatttactcagtctcgggtatgtccttatcagcagcgtgaaaatggactaatacactgtgacttcgttttctataagtgggaatagtaatggcatctacctctatgttactatattatgtttgttattattattattattattattacccctggatgaatgaaaactttagacttcattggaatgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaaggtaaatatttaaagaaaaactacatctggaagttatttataagaaataagagctgggtgtggtagctcacacttgtaatataacaactttgggaggctgaggcaggagaatcgcgtgagccctggagcttgagagcagccctggcaacatagcgagactaaataaataaataaatattagctgggtgtcgcaccacatgcctgtagtcccagctactcactcaggaggctgaggtgggaggatggcttgagcctgggaggtcaaggctgcagtgaaccctgatcccagcactgtactccagattgggtgacagagcacaccctgtctcagaaggaaggaaaggaaggagaatatatctgaaaattgtttacagaatataaatttgaagccaggcatggtggctcacacctataatcccagcactttgggaggccaaagtgggaggatcacttgagcccaggagtttgagaccagcctgggcatgaaagtgagtcctcatctctacaaaaaaaaaaaaaataaaaataataataataataataataatctattttaaaagaaaataaatttgagattggaaggaaaaattttcttacaaagcttgatctgagtatagataatatgagaagcacatagatttgttacattttaacagaaatgaaaacactacgtatcaaaatttgttgacatgacagccaaagctgtactcaaatataaatccttgggaaaaaggtttgatgcttcctcaaaaagttaaacatagaattaacataggattcagccattttacccctagatatatacccaagagaactgaaaacatatctccatacaaaactgtgctatgaaagttcataacattattactaacaatttttaaaaggtagaaacaaccctaaggttcattgacaaatgactggagaaaccaaatgtggtatatccactgtgaaatactatgcagccatgaaaaagaatgaagctttgatttgtgctacaacacaaagtaaccttgaaacatcatgctaagtgaaagaagcactccagcctgggtgacagagcgagacaccagctcaaaaaaaaaaaaaaaaaaaagttcttcaagaatggactcactcattagttccttccttcattgatatctgttcattcatctgtttatatggaacagtcagggttgagaaccactgttccaacaagaagctatacttgttttgttttgtgtgtgtttgtttctgcagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtctctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctatattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccatctgctccccaaaaactattgaaataaaataaaatataaaaagaaagagaaagaaaagaaaatagttccaatttatcatgccaaattgtttgaacccttgattctttcttgacttacaagctacactttaaggggcgtgggcagagagcggtcttctaaactctagactgaagaggattgaagttgagctccagcattctcactgccatggcttcccagatattacattaaaataaagaattcctgctcttttgcctgggggtcagtgcctgcctccaggcatttggggtatatgtaaagatgtacatgtttggccgggcacagtggctcacatctataatcccagcactttggggggtcgaggcgcgtggatcacctgaggtcaggagttcaagaccagcctggccaacatagtgaaaccccgtctctaccaaaaaatacaaaaattagcccagcatggcagcgcacgcctgtaattccagctacttgggaggctgaggcaggagaatcacttgaacctgggaggcggatgttgcagtgagccgagatcacaccattgcacttcagccggggtgacagagtgagactccatctcaaaaacaaaacaaaacaaaacaaaaacatgtttgtggaactgctccatgaacaaagctccaattgggtccccagtctccattcccacttctgacccacactcttcatcacacctgctggctctgagttcaaagcctcccctgagttttatcaggtgggtcaattagaagtaggagttgcaaaatgcaatttattttatctgccctttactctgagggtacacccaatatgccccagaccaccatacccctaatcttttgacacggcaggcccctaaaccagtgtagggtttatctcccagcctctggagcacatccagttgctagcctcttcttgttatcaggtgcaattagcatgatgtcataaacacaggggactacctttatgttctgggcaatggctggacgattcaggtttcttagaacaatactacaaggagaagaaaattaacacagtcctggaacaagactgtgaaagtatactgttgtccatgccaagcgaatgcgcctgcctctgttcctccttcctgatggtggcggaaaggatgcttttgccagatcaacagtcacacacaacacaccaggttatgctcatctattctagtaaacctgtcactgttggcacagaagctggaaatttggctattcctttaatatggtggtgggtttgttgttgttttgttttgttttgttttgttttgttttgttttgttttgttttgttttggagacagggtctcactctgttgcccaagctggagtgcagtggcacaatcatagctagctcactgcagcctccaactcctgagcttcagtgatcctcttgcctcagccgagtagctgacactacagttgtgcaacattgcactggctaattttttaaaacacttttcggtaaagaaaggatcttgctctgttgcctaggctagcctcaatctcctgggctcaagtgatcctcctgcctcagccttgcaaagtgctgggattacaggtgtgagccaccatgcccaggctcttggtttagttttccctagcccattgaccttggtaaattaaaggcagatctagtgggaccatgccttgttttctttgtcttggggggtggcactgatctctgtgttcctggcagaatgtgatattgtttgggatttactatcttggccacagcagagggacagcctcagcggcttccccttggccttccccagtctgatcacttttaccacacagaccagagagtcagtattcatatgcactggttgctaagtgtatccacttctatcatttctaaaaatcagggcaagaaccactgggatgcctctctcatctctaggatcttgattttgcctctggttctactcaggactcgctgcctggtccaagtgctcagcttgtctcagactgcccagtgactccacctgccctcttcccttctggaattctctcagccccattgctcctatggagctcagttatgtaatggcatctcctcccgtgagcctggcctacagagacagccactgctgagcttctccataatgctaatgccccatcaccaacatagttcttatttccctggtattggagtatcctccagggcatcccaaggataacactcattaaatactaatttagtgaaactagcatattttacctaaaaacacaatcaaataatttcatgtgagtctttttaaaaacaaccttgtttttttatagcagttttaggctcacagcaaaattgagcaggaagtacagagatttcccatgtacctcctaccctcacacaggcacagcctcccccattatcaacatcccccaccagagtgggacatctgttacaattggggaatctatattgacacaccatgaccatttgaagtccatgtttgcattagggttcaatcttagtgttgcatattctatgggtttggacaaatggatgatgagagcatcctatagagtaggttcactgccttgaagatgctctgtgtttccttgagccttttgatcccttcttccacccttccatgacatctttacatcattgaatgtggggttttgttgcttctaagcttctcagggccatcccagcagtgtactaggaccagtctcccagctttgcaagtggtgagtcctcctacattgcatggatgagtacctctatgttgaaaaacccttcctggctcagcactatagtccactgccctgggatccactctcacacacactcttctaactggttcatgccagcgtatattagttctccttttcccttagcagcccagcgtgtccctaggtgggccaggctgacactcaacgttggttatcggtcaggaagagaaatgagggcagattcctcaagtagatccttagggggcagcaatgtctggtgaggcatctgcttcattggagacctcagcatcaacttcaacaggggagctgttaccttctaacaagcatcaggccgctctgcagtgggaggctcgagggctcaaatgaattgtcaaatgtcccatcttcaggttcctacttttccctacaggagcctgacttgttgaggctaaggattgagttttcactgaaatttcacttctcttaaacttaggtcttggcctgtgtattagtccgttcttatgttgccaaaagagacatacccgaggctgggtaatttataaatgaaagaggtttaatggactcacagttccacatggctggagaggcctcacaatcatggcagaaggcaaatgaggagcaaagtcacgtcttaaatggcagcaggcaagagagcttgtgcaggggaactcccctttataaaaccatcagaactcatgaggcttattcactattgcaagaacagtatggaaaaccccgcacccattattcaattacctcccactgggtccctcctggtggggattatgggagctacaattcaaatgagatttgggtggggacacagccaaaccatatcagcctgatctacggcacaattttttctccagatagagggaatggggatcccttcaaaagctgctaaggagggtaccagaagcccgccaaaggcatggtctaaaatgttcacagcacactatgcatcatggccctgaacttgaaactagctgaatgcccataaataatacatttgaaaaaatcataaaaacaacaagaaaagtgtttcaaattgtgcactttaaatatgtgcagtttattttatcccaattataccttaataaaactgggaaggaaggaaggaaggaaggaaggaaggaaggaaggaaggaaggaaggaaggaaagaaggaagaaagaaagtctgtctatggtccctgaagtcctgccccctcccatgcgttcttggctctaggcagcagcaccagggctcaccaagacactccaaaatcccaagagaaggtgcagcttcaaacataaacagaaggcccggatcacacctgtaatcccagcactttgggaggccaaggcaggcagatcacttgagtccaggagttcaagaccagcctggccaacatggcaaaaccccgtctctactaaacatacaaaaattagtctggtgtggtggcacatgcctgtagtcccagctactcgggaggctgaggcaggagaattgcttgaacccaggaggcggaagttacagtgagccaagatcacaccactgcactccagcctgggtgatagagcaagactctgtctcaaaaataaataaataaacaaacataaacagatattgctcaggggcctcctccacttcctccccaagaactgacccaccacgccctcctctgctcccactggcaaagctttctgctgctctgcctctaatcccccacccctgcaaagccctttgcaggtgaagatatgatgggctttgtcttaggaaggctaaactgacagggggttaaggagggaacacagcagggagtcgggaagccccagggccatggaccaggcacagtaatagaccaatcttagagtgaagaggacacggaatttaattttgagcacatctgagctgttaacaaagtgggtatctctatgaaacaaccaataggcactggaaatgacagccaagcactgaggcaggaaatcaggtgacaaactgcttttgacagtcttgtgcatagaggtgactttagagtgcaggtgaggacactccctggagagaagggctccagaggagagcatcaggacaggctcctgcagatgcagggtggtgggggcaggaatggattaggcagtgagagcaaggaggggcttcagcaaagaaggaggagaggaagagggagcaggtgacagaggagggaggggaccatctaaaggaagaggggggagtctgggaaagtcactttggggatcaacagagcaagcagtttcggtgcagtgagattggccaaaagccaactgcagggaaaatgtgcagagatggggaggaaggaaccagggcaaagtggggctagagaaaaaaggcaacttccccttccccaactacctaccacaagcctccagtttggagtgactcaggaccccagaggaagctttcctagagaggagcactgagtcaggctccagaagagataacagcccagggctggaagggtggtttgagatgccctgccgtggggctgcctggaaagagcctggggcacaggctgtttctccagcgaggctggatgggagcactgtgctgtgttcttcccaaagtgcaaagccagcgcgcctcgatcaatcccttccctccacgctctgagacaaagccagggcgcctccatcaatcccttccctctacgctctgaggcaaagccagcgtgcctccatcaatcccttccgtccacgctctgagccttactgtactccctgccctgtgttgttggcagatgctcctaaatcacagacagctgcagatggagcccaggccaggcctggaccatttacttccccagttcattgaagacgtatcatcacaccacacacactccaaaaagacagcaccacgtttctcttaattcatgaatttaggaagtaactaaagaaaaaaaaaggaagcagttgagaaaacaaacaaaaaaaatgatttagacaagtaggaagcagtttgcctctgggttcagttacaagttgctggagggcagctggtattaactcatcaccagggagagagcacagacaggcaggggcatgtagtgctcactggtcctgttccttctcatccttccaggtaagtgggcctggggattaaggaactggaacccaaaaggctgggcaggaaacagagagggtctgtgctggagggaaggagacaagctggggaaaatgcactcatccatgcacttacatataagaaagcaggaaggaaggaaaagagaaaaaaagggaggaatgttttgttatctgacagttactaggttaggtgttggggaaagaaacaaaaaacataaatggtgtcaggtttctaggattctgattcttctcaaccctggcagatgatagatagatagatagatagatagatagatagatagatagatagataattgatagacagacagatagatgatagatgatagatagatgatagatagatagatagatagatagatagatagatagatagatagatagatagatgagagagaagtaaatggatggatgatagacgagagacagatagatgcatggacaggtggacagatagatgaaagaacagataaataggtagatacatacatacttatatacttgcacatatacacatatacccaaacttaaatgcatgaatccctgaggaactttaaaagagcacaaatactcaggttccagctcagacccacgcagtcgtggcggggttcagacatctggctagtttagaagcctccacagcttgtcatgagttgtagctaaaatggagcagctcagagttacagggaggaagacaggcaataaggcaaggatgtcatcgctctctggaatgtaagtcaaccccacacatcagcctgcttgagcttctgctctggacgagccaaagaccagaccattgttcaaggttgtaagtacaacaactgagacagatacaaagtggtctggtggcaccagggcggggctgaaccaacccttcagggaggggaataagggcttaagtccatcaagcaaggaagagacaacttcctgggcaaagggagcaacttgtgcaaaggtatggagacaaaaatagcatggtgcttaggcaaagaaaaacaactgtgcactgagtgtgtgcacaggtgtgtgagtgttgggggtgtgtgtgtgtgtgggggtgtgggtgtgtttggttccatgaaactttatcacatgtgcagactcacaggagagggtttttaggggtgtggggtgcagtgccagtgggcggaggagttgggggaagccaggatgtctacctgttcagctctgggattttaaaataaatcggtggctggccgggcgcggtggctcatacctgtaatcccagcactttgggaggccgaggagggcagatcacctgaggtcgggagttcaagatcagcctgaccaacatggagaaaccctgtctctactaaaaatacaaaattagtcgggcgtggtggcgcatgcctgtaatcccagctactcgggaggctgaggcaggaggattgcttgaacccagaaggcggaggttgcggtgagccgagatcgcaccattgcactccagcctgggcaacaagagcaaaactccgtctccaaataaatacataaatacataaataaataaaataaactggtggctgcagtgagagccagggattggtggggaagtgggtgtcacctcagggcaaaggagggaaggtttccaaaatgagagggtgttcagtggtcgctaggatggcgcatgaacagaccactgtgttgggcagttggagccctcaggagaactttgtcagaggggtgacaacaaaagaaatactgccggggaattaaggaacaaatggatgtgagaatttgacaatttgggggctgaggataaaggctcctggttggtccccagggaggtgccggaagccctgggcagtgcccagggagggaagatctggacgttgggttctgtcttccagagtatttctccatctatggtcctagagctgtgtggggcacagaatgggactcactgacagtgcagtgtcattatgaccaaggctgggagacctacagcaagtagtggtgccacgggaaggactggcagtcctgcaaaatcctcattacaatcacaggatcagagcagacagcggagagagaccgagtgtccatcagggacgatcagaaacatataccctaaaacttaaagtataataataataaaatttaaaaaaagaaaagaaaagaaaaaccgtgtgttcaccataaccatgaagatgctctggaggtccgacactgacacctactggtgtgggattgagaggacaggcactgaccttggggtccaagttgaagtgaccatttacccaggtcggagcagctccctcctgtaccaaactctggtgctgacccgagaggattcagtgatgctgtcttgacattgtcctgggactacgtgtgtgcatgggcttgtgtgtgcttgtgtgtgcctgtgtatgtgtgcctgggcttgcccgtgtctatatgtgtgctgtgcatagatgtatgtgtacgaatgggcccgtgtgtgtctgtgtgtacatgtctgtgtttgtgggcctatgtgtgtgcatgtgcatgtgtgtgtgtttggggggaggggttacaccaagattctggaaagactggaagacagagcaagcctcagtatctctgtatgtctctatctgctattatcagagggagccaagcagaactgggtcagcttgggcaggcacagtgcagggtaagaaagaaggcaggttctcttctgcaagtcacttggggcaacccgtgccccctcagagcagccccagcctgacgggaggacttgtcaggtgtacagggaggggaatgcaagaaaatcgcaatcccagaagtctcagctccaggacaagcatgtagtgaccaagagcccattggtgaccctctccttggagccacctctctctcgtcctctcccacctctggtgacatatggacaaaggaaggcatgggagactctgacccattcctgaaagagggaaaaacagaacccggcatagtgcagagccctcccacaggcctcccctggctgccccgagcctttgaggatactgagaactcacaacagggggctcctagaaagagagtccggctgtcatcctcactccacagcccagcccccagagccatcagtgtcatctccgccgtgggcaccagagaaactgtcagctccccatgcacatgcatagatgctgcagctcaatcatatatctgttacttgtgggcccatttacaaggcagggaaaagtccttttcagcttagtatatgcggatgtggtgtgcctgtgtgtgtgtgcagtggggaagtctggttttagaatgtttcagaaattgacttaaaaagagaacaaaggcatgagtggaaggaaaggaggagctgggggagagtcggaggctgcaaccctccaagcctagtgaaataaggaagctttggggaggcaggaaaacttcagctggaaacagatgctctgcccagctgcaggggagaggagtcctgagtccccaggcagggcccagggaggggcagctggctctgagggtcactttgctacacagcaggcaacaaacagcctgctggagcccaggctgagactcaagagaagggctggctggctctgatgtagaacttcagggaagcagagtgtggttctcaacgctcagctgtgcaacgcaggactctgggactaagttgaatatttgtaaattgcctgcatagcttctcgccacaagtccttcccaggtggtgcagtgatgtttgtttgtaagtgaaataatattacattttaggtaagataccaaaaagatacaaaacaaaacaactgtagtgctaagactaaatgcttcacgatccttggaggggtaagaggtgacgtgagccacggggaagccacctaggtcaccctcaaaactatcctttgcatgtcccacagcaactccaagaaaacaatctgaacctaagacaacagacgcagctgcacctgggacagcagacacagctgggcctgggacaatggacacagctgtacctagaaaagcagaaacagctgtgcctgggaaaaggaacacagctgtgcctggaacagcagacccagcttcacctgggacagcagacacagcagaacctatgagaacaaccactccaacagttctggcctcctggccttctctcacccagagcaccaacagcacccagcccacggctcttaccagccccctcaccaggtgagcagagctgggctcccacagacctttccctaggctgccccatgactgctccttcagatgctctcaccagggaccctcatgtggcgctcgtcaggggagaaacagtgaagtctgtagtgggccttcccctccctgtctacacctgagcactgcaggagattctccctgatgagctgcaacaggctgagctccagagagcaggctctgggctccatgcttcaccgagtccctcaagccccaggaggcaaaagcgaggtgaagctttgggtgctctggaagggcagctgtctgggtggctttcctgtggctgctgtaactgatcgttacaaactttgtggcttaaaacaacacagtctcatgatcatacagctgtggagaccagaagtctgaaatgggtctcactgggctgaaatcaaggtgttaacagggctggttccttctagaggctccagcggagggcctgttcccttgccttttccagcttctggaggccacccgtgttccttggctcatggccccctcctacccaaagccagcaaaggtcggtggagtctcccacagagcatcgctccactgtctctcctgcctccctctttcatttataaggacgctggtgattccactgggctcagccagatgatccaggataatccaccctgggtcacctgacgagcagtctcaaatccacccactgccttaattcccccttgcatgtaataaaacatattcacaggctttggggttatgacatcgtgggtggggttcactattctgcctaccacagtcacaggcaggggtgtgcccatcgctccaactctccagccaaggctagggaagggcagggcgggagagcgggaagctgggcctcttgcttttctttcacattcccagcatggtagatgggtgtggacatcaatccgaagcccacctcctttcgagggatcaataggatgtctcatcaccgcgcaaatgcggctgcccctgtttaaccccatcacagcctggtgcttcaggatccctcaaagtccagggtcaaggcccattctctccctggatcctgccttccctgctccaccggctcccttctccagcccaactccgttcctttcaaagggtcttgttccctggagcctgccagcaccgatcctgtgttccctaggagtccggaagaggcgaggcactggggatgcttcctgacctggccttcgtctcgctccactgtttgcagagcggttgttctgctgagtggggatggcagtgccaggacttctagcgagacgggagaggcacaaggggaaacttggcgggaagagaccaagggtgcggcggctccacggggagtggaacttgcaagaagaacacagtggtttaaagggtatttttaggatgtgcaatatggcaggcctgctctcactcaagaaaactctgagttaaattcacatgactcatcactgcttccatgccctgggctggaggccagcttcggggagagaacagggatggcctgagggaaagggccctggcactgggtgtaggggagtggatgaggaataagactggggaatcagactcttacacgctgatggggactccccagaacccactcgtttagctagaccaaatattaaacatgtgggtgatatgaggcagcaggtctcagatctgctgtcataaagtgggtccaagcaggaggagacccctcccaggagaaccaaatagataaatagccaggttgttagaagtgggggaatcttcctgtgcttcaaagaggtaataataattagatttgagcttgaaagatgggcagaagtgacaaagggagacacaaggcagagagaggagcagaagcaggaatacaggacacagcagaccctcgagcttggcgggacacaggtgagtagcagggactgtgggaaagaagaccaaaggcaggcctggctgggtgcagtggctcacgcctgtcatctcagcactttgggaggccaaggcaggaggatggcttgagctcagtagttcaaaatcagcctggggtatatagcgagacgccatctcggcaaataatgttaaaggctgggcagtcacggccaagggcagcgaaggggccgggccccagactgagcctgtgggaaggccactggaagctcagcctccgggtggcatgactttgccccttgcatggggcttccctggttggggaccaggcagctgaccagggtggcaggtgttggctcagggaagaggctgctcactcttggcatcttgacccctttgtccaggatcctgctctgcaacatccacttcctgctcccgatctccctgaaggggctgctgctcgtgggcctgctctgcactgtgctgcaagtgagcagtgctaagggggcctccagggggaaataaagtcacagcctgagccggggaaccgcagctcccacaccatcaacaccctcggagggggcaagcagaacctctggcctcctatcaggtaataagcagcaattgcagttccccaggagacaagggtccctgcagagatgaaatatccctcatcctggcctcaggaaggcaatcccactcccagctggctctgcacagcacagggatgctgacggggcctctctgccttctgccacctctgcctcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatcccccacccggctcagaactggcacagccaccaccaaccactcctgattcaacccaagcttcgccctttccacctctcgagctgtgcaacaacaaatgcaggatgctcagccctcatgtgtcagtcccctcaattcacttgtaattaaataacaacacacctctttttctaattttcaaaggtgtatatatttcccctcaataaagttgttaggattatttttctcttccacttacattcttcctgaactctgcctgctcttttttcttccatattttactttaaatacttttttttgaattactatatttcttttcttagctcctttttttggagagatcttgttgtcttaacttctctaagaaggaggggaattttccatctgaactcttcctctattgccttgagcacttcctctcctgagacgggttcttcaactgccatttgctagtgttcatttcttctccttgatctcatcagctgtgaacaggtgctggtgtgctttataacttttctctgaatgaggttgaagattggccaagagtagtgtcaggagccatggaggcagagccatggagggcagagcatggagggcagagtgtggaaggcagagccatggagggcagagggtggagggcaatgtggagggcagaccgtggaaggcagagccatggagggcagagcatggagggctattgacacagtggaaagtttgttttcgggaacactcaccacttgccacatcttgactacctgtgtccatatggttcatgtgttgagaaagggcaagacctcaggctccagcagcctgcatgctgctaagcataagagaacagcctgtgttgttgcaatgtgaaccatggtcacacaggctggttgctattgtcatctggaggcttcttcacccacgagtctggagcatgggctggggtgatccaagacagctctgctgggactgttgcccagagaccctacatgtggcctctctgtgacagctgggttctaaaagggaatatctgcagaccttccagagggcaagcgtttcaatagactgaagagggagctgcagggtttcttctgacttagccttggaagccatacggaggccctcttgcattccccatgggggcaaatattggttcttgcagggtggaaaaatatttttactctttctagatacaaaacagagatatagatggatggatggatagatagatagataggtagatagatagataggtaggtaggtagatagatagatagatagatagatagatagatagatagatagacaggtgaatggatggatgtacaatacatctttggtattaacatttcatgaggggagatatttagggatattctttttttagggatattcattgttatcttaggataacaatgaaaaaatgttgagaaacactgttctagtccacaagttgaaacagtcacaacccagccagacccaaggggaggggacctaagccacaactcttcatggaaggagtatcaagaaatttgcagccatgtttttaaactgccttgtggaagaatcataatgtagcgccttcatgtcacatataagaatagcgggacgtgaaggggtgaagccacctggtccccagtcacaaggccagagagcagagttgattctgcctctgaatggcagcctggagctggcccacacagcatccctgcaggcccatctgtgcactttagaaggtcacttcccaagcctgctgggggcaccatatggtcccaagaataaaaatgaggccctgaaacacctatcctttactcagaggtcacagtccagcagccattacttgcacagacatgtcttgtttgggttcagtgggtgaatggttaaacaaattattttacacccatgcaatgaaatcctgctgagcaataggaaggaatcagctattggttgtggtaagtgcaaccacttgtatggatctcaaggctcagtgaattaaaaagtcaatctcaaaatattacatactgcataatttcatttgtcctcaaaaggatgacactgtagagatggagaacagattagtggtttccaggggacaggaatgggataagggtgcaaatacaagggacagcatgagggagatccttgtgatgatggattggttctgtattttgacgggggtggtagttacctggatctgtaaaattgcatggaactctacacaaacatatccataaaccaatgtatgttaaaaacggtgaaaactgaacaaagtctgcagtctagctaacagtattgtaacaatgctggtttcctggtttgggtcttgtcctacagttatataatacatcaccattgaaagacactagatgaaggattcacaggactctatgttatatttgcaatgttaagcctataatcatttcaaaataaaagtttcaaaaattaaaacctccaggggctccctatggcctccagaacacaattcaaacttcttggtctgccatgaagccctttcagactgaggctccagccccatatctcactcctccctcacatgcactctgcacacatggtaatggtaacgtagctcctgaaggtcctggtatccaccatgctctatgactcttccctaccattgtctgggacaatcatcccccagtcttctgccctatttttataactcaagccctcaattttccttctccgcttggccctcatgggagtgcctcccttctgtgcccccacagagcactgtgcagaaccctgacacaaattctaacacaccgcatcgctattgttagtctacatcttagacttcccttctaaaggagtagggactctgcatagtttaagtccttatctgtaatgcccagaacaatgcaccatagacacacaataaaagtttattgaatgaatgagtaaataaagggaaaaaagaaaggaagaataggggaaaaaaagggagtaagggagaagggaaaattcaaagcatggagaagccactgtttgtttctcctgcacctgctgtctgccatctgtctactctttcttaactcttctcttctggcttctgctgtcattgctctgttgatctgctcttctgaacttcattagtgaccttgtgaatgataagttcaatagcctcctctcaatcccggtcctcctccacctctctagctctgctctcctccttgaaacattcatggctcttgacttctcatcttccacctgtttgattctgctccagcaccttgatcaatgtcttcctcctaccctttgtctttaaatgcaggtgccccgagggctctgtccttggttctgaactcttccctccatgttttcacttcttgctgggttccagttaatctctctacacacattcctctccagccctcaacactctgctaacccacatctctagctatctgctagacctctctgcctgatgattccaaacacacagaaaactaagctctgcatcatccaagcctgctcttgactttcctacttctgtcaatgatgcccgattcctctggttttccaggcttaagactccggactcccagattcttcctttcagactttgctacatctgctaggcaagtcctcctaaagcacatctgcaatcccatcttgttctgctcaaatccatcccaccatagctaatcaaagtttaagtaagagttgagtcctaagcctcctgaacctgccaccacctgagttcttctagattagttccatctggcctgccacaggaaaatttcactccattggaatcttagacacatcctaccatgagcatctgtatgtgaacagtacagtccatttgctgataggtcttctataagtgactattgttatgaagattatttcccgcctctctgctttcacttatgctgtttctctgtcctctctctctccctgttgctccatccctgctccgctgaaatcctatacctccttcaacatcaacatgaatgtcaccttctttccctgacctggccagcttggcatgatattctcctcaccaaccccctgacatcaggaagcatctcttgtggctctagagttcttcctatgctgtaatgacttgggagcttatccttctcataaaatgaatcataagctcctttcttgctcatcatcatatttcccgggttaatataattaatatgggccttgttagattgaatttctctttcagcatgagtcctgggccagccccatctttcccctagtcaccatgcatgatggagctgggagccccaccagagctcaagttcagagcacggcagctctgcctaagcactcggcactcagagggtcactccatgtgctctggacactggcatcactagctcaggatgagctcaggcctgggggcagagggggagcactggtccagatgtaggtagcaagtggagatggtgatgcttgcttgtggcagactgtgggagtcctccccacaaactttagggaaacagagtaattgacaaacattcagaaaaccaactgagctcattcccgagccaggggtcaccagtagtggtgatagcactgtgcacttcaagtgtggacaagtatccttcacctctgtgccctccatcctgtctttgaaaaacgatatctgctctgcctgtggaaaaggttaattgctaacaggtggtctcagccagacttctaaagtggacagaactgactctgttgaccttgtgcattggacacctccaggtgggggaattccaggagtgatatcaggggcacccaccagctccttctccctttactgtttcaactcgccccagaactttaacctggagcagctcatccacggcccacccaggcagagatgttctgagcccagccacacactgcctggttacagggagagaaggggccttaaagccagggagacccaaggggcgtcagaagacgagaggagccctgagcatgtgggacactgggcaactgcatgagcaagctctgccgggaccaagctcccttggggttgtcccagagaagagatggagctctgtgagcctaaaggctggggctgtgaggggtgtgtcctcagggagactcctgtctgcaggaaggaggtagttattgccctgggggaaactggcctgagaagcatttgtgccaagaagaatgaagggccaggctcctccagaaaattttttccctcccttcctccgtccttttctctctctctctctctctctcgctctctctctctctctctctctgtctctctctctctctctctctctctctctctgagacagggctctctatgttgcccaggctggcctggaactcttacgttcagccgatcctcctgcctcagcctcctgagctgggattataggcactcgctatggtgcccggccaacttccagggaattcttgcccttgggaagtgggcatgagggcagggaggcaggggactggggaggagaaaggaggacccccaagctgcacattgaggactccagaggagtgtcctctaagagccaggaccctcctttgaggcacaggaacaataaatccctccagagtccacaggtctctcgcatccagtctgaaaggttgactccctgcacggggcactcctggggatggggctctgcagggcttcgggtcagcctggctctatcttccaggaggagcccactgaggcctgttcacccagaagacagcacccagcatgctcaggagcaggggcagcttcagaaggaccacgagcaggaagtgagggctgctgagccggaacctgtggtggacacggtgaaaatgagtcacttccccgggagaacccccaggacccttctctccccacctctccccatgctctgactctggagcccaaataacccaggagcagccagggaaaggacctatgccagggcagccccttctgtggcccccatccctccttctccctccatcaaggactgcccggggggtctcatcaaggagaggtgatggagtgaagacagaagagggacccacttccaggagtgcgctccacagcaccctctctgtccctgtcccactcacagcctccactttatcaactgacttcttaaaaccagtccccactctcgctttttttattttctgagacagagtctcactctgtcacccaggctggagtgcagtggtgcaatcatggctcactgcagccttgacttcctgggctcaagtgattctcccacctcagcctcctgagtagctgggactacaggcgcaccaccacacctggctaattttgtatttcgtagtagagacagggtttcaccatgttgcccaggctggtctcaatctcctggactcaagtgatccaccgcctcggcctcccaaactgttgggattgcaggcgtgagccaccacacccggccaccactctcactgttccactccagctccttgttccctcccctcagggtctagcagcaatatcacagccctttctggatatctttgggagaggagagagaactgattcaaaccccagcctggagctggcccatctccccacagaccccacagacagctcctggtggcaaaatccccagctgagcaaagacctttgaaaagggccacagaactgggaccccaagtccggagctggatggggaaggagacaggaaggagtggggaagggaggaggggctgcacgtccacctgaactcaaccttcgacctgagtcccagtagctgccccatagggaaaggcgttcacagcacaagtgatatttcccactcagcatccacatgcagcctcagagagtatgagaatcaggaccagagatggagagaaacagcagacagtgacgatctcaggtcacggtgcgccacccccaccccccagcttccaccccagggttgctccctccatggcctccaggccctgcgtgcttaccctgaattttgggtcaacacctccccggtgctgaggtttcgcccagggttcaccaccaggaagatgggaggtgtggctggatgtgtggtcctccttggggttgtaattgctgttggagatgaaaatgatgcatcagccgtgcctgggctcccagccatgcacagaacacccgtatggatgtcatacagaatcacccactcacagaagaggctggaaagatcttctgaagccagatccagggcacctcctgggtgaaacccctcagggacaaaaagagcccttaccagaaccagccatgagagtcccctccaataagtgccaggtctttctctgcatctcagagaaagactcttaccactctgcccactctgccctcatcccactctgcctggggtgagggcaggggtctctctgggcttccgcagccagatgtggagttccaggaggaggaggggaaggaggagtctaaaggaagatggctcagcctgtggcccaagaagcctcgtagagaccatgagagggggctctgagcacccttcatgtggacactcttttttttttttttttttttgagatggagtttcactcttgttgcccaggttggttggagtgcaatggcacaatctcagctcaccacaacctccacctcccgggttcaagcgattctcctgcctcagccacccaagtagctgggattacaggcatatgccaccacgtttggctaattttgtatttttagttgagatggggtttctccatgttgatcaggctggtctcgaactcctggcctcaggtgatctgccctccttggcctcccaaagtgctgggattacaggcgtgagccaccgcgcccggcccatgtggaaaggccactgtaggccacccctagggaggggataggttgacactcggctcctcctaaggacttcaggtgaccaccagactattgacatagtctactccctcattgccactggactcccagctcatgatctccctaaagcagttgtcctggaggctcagcccttcaccggtgcccgacacaggctcagtgtgatccgataagccgcgttcaacctctctgttgctggagattcgttgatggacgtggcatgagccccaccccgttggaggggcagagacacataaacagacggactcacttccgctggaagcagccctgggaaggagccccagcaggtgcaatgggagcacaggggagaagcctaatccacccccaggccagcagtgaggaaaacatgggcggcacctagcagaggcgaatgccggaccatgggatgcttttgggaagtgagagacatgatagagtgtgagtctgaggacaggagatggtgtggatagctaaggggcagggggcaggggaatttggttcaagagggatggggaggcagaaaaccacaggacaaggagccagccccaggaggatcacccttgggcaggatggggaagcctgtcctcaacccgaaagggaaaggggaagaatgagtgtagattgcatgaaagtttgcaagtggagaaggaaagaaactgatgtcctgtgtgttctcaggaaggtagatgtatgggagagtaatgttggaaactcttaacttctactggcagccacaggcaccattttctcactttttttccccagcagcgctagagcaggtggattttagacagggcgaccaactttcccaggacttttctagccttagcactgaaaatcccacatttgggaaaccccttagtcctgggcaaactgggatgattagtgacctttattttaggattgatccagggatgagggttttgtcaggtagataaggaaatggaatatgggagttatgagtgctgctaagagaagaaaatgtcaggctgggcatggtgtctcactcctatagtcccagcaccttgggaggccaaagcgggtggatgacttgaggtcaggagtttgagacctgtctgggcaacgcgggaagatgctgtctctactaaaaaatacaaaattagccaggcatggtagtgcacacctgaagtaccagctactcagggggctgaggtgggaggatcacgagcccaggaggcggaggttgcagtaagccgagatcgctccacggcactccagcctgggcaacagagtgagaccatgtctcaataaaagaaaaaagaaaatgtgatctattgcaggggctcaaagtggtctaggaaggaagtgaggtcagaacgggagtgatgggggcaataaattggcggaaatggagggatcagaagacagaaggtcactgtgaggttgagaatagggacaatggcatgaggatgggggagagctgattgatgaaaagttgtcagaaaatagaatgtctgagtttaagactctgggcagcgaccaggtcgggtgatgacaagctctgaggtgtttccatggggtgcaattctgaagagagtagaaaataaaggacaccaaggttgagaatgtcaaggaacccaaggcaagattgccaagttattcattaaagcctgccaagataatggcagaggttggagtggaggcactggcaggactccgttgaatgagggggagcagcctggaagctgatggtcggccttgtcaagcacaggtagagggtgggcatggccatctggcacagcatttaaaggaagcaggtggaaagtcatagggcggaagttgtgatgtgggcaggaagaattgggacacggctccatggccctctagcatagggggagtaagagaaagagtagcttccactcaagaagctactaaacaggaaggtcttcccaagcaagacatatttcaaaacaacatggtagggggatgttctgtgaggaggctgcaaatgtacaggagtgtttcttctttggtacaggcttcccaaagggcacggtggaaacagctttggctcagcatgaaggggcctcctccacgctggataatggggtgaggcccaggccctatgggagtgatggcgcctgagctgtgcaccccccagcccacccaaggctgaaggatcagccgcctctctccatgcccatgccataggctcctcccaacaccactgtgactgaggacaagacaagacttggacgcacacttcagtgtgccgcccacccttgttcccttgtccagtcgcaccccaaaccctgctgccaaagtgaggggagctcttacctggggaaacatacaccctaaccaggtccgagggatcgcgtgaccatgaatccaggacccacactgtctgaattttgcaccagtaagatccagcatcatcttcattgaggttctgcatggtcacagtgaaggcgagagcctccgggtggtctctgatggacacgcggccattcctctccaccttctcttctcccttggtctccacaatgctctcacatgacgtgtcgtactgtcctcggcaccagtacttgttatatcccttgtacatgctctcatactgacaccacactgtcagagagtcccccgcagtgccagtcacagagccggggcccttcagagacaaacagcctggaaaacacaagcccgagtcccaagtctccatccagatggccccatcagcagccgtctgtctgaagcttaaggggaagattgccagggagacctgggtgtttcctgggaggggaacctggaggaatacttgagcttaggacctaagccaaagagtccctgtgagagcagaaacctgtcccctgtgagagcagggacaccaagtcacagcacaggggccccagcacctggagaccaaagctggaggcaggagcagagaggagctggtcatcccacctcgtcctgggccctgcagcctctgccaggcatgagatttggtcatatacaagatcacttccctttggagtgagacccatatattctggggtcttctgaatctcaggcttattctttaaaagcacaacttgcggtttcctccactttcagagtgttcttgtgggaggaaaaatactctccggctctgatcttaaccactctccagaaagaatcaacatggcactgggaagaggggttgtccccaaaggaagccctgataagcttctttacctgaatttgggacacaagatgacccccccgacaatagtccccaggtcttgggagtcagaggtcaccatgcattcagaggaaagagggaagctgctctctgtaaccaagtgaggtgatttgggtcctgggaggaaagtggggtttagaatctgggaggcaaagtgtgagaagttgatacggaagcaaagagaagggacaagaaaggctgtaggtaggcagaagttcaggcattatgggatgtgatgctcagcagagccccccaatatcttaagcaagtgctgaaaaactgacaagaggctttgtttgaacttgagtgtatgtgcatgtgcacgtgtgtgtgggtgtgagagagagggagagaaagagaaacagtgatgaggctgagctttgcaccccctcagagtaacctgagttcacaataagaggatgaatacgcgcaggggccacggaagcttaagccgttagaatgagcagaaattgtgaaagagcccctggcatctgtgggtcctatgactatctgggctcctgagctaactacatctagatctgaggtgattgaggatggaggagcccctgacttctggctttcattcatttccctcccctcctcccaccatctgcctttcctccccactctgtctgcagctggctctgtctgtcatatgccttggcagatgtgtgagctgccaccacgcacaccttcctcaccccaccaaccatgcttggcctgagacaatctcactgtcactatctcttcccaccctcctggtcccttccacactcagtagcacctgtcacccccaccctgaccccttcccagcccctaccccaaaccctgctccaaacctgtgttttcccgctctgtgctcccttgaccacagcaaagtggctcctgaccccgcaccttctgagcactccccatttctctgctgtcctaattctcgtaagaaccttcctcgctctggatgctgtgccctcaggaatcttcccattcccaaatccctgctccccacctacgttctcccccaagaacctgttgccccgcagctgcacacccctcctgagatttgagagctggtcctcacctcctcccttccacctgcccccagcttcctcctggaggtggcacatcccagcagcacctccttctaggttctggacagagctcaggactgcatttcccacagtgggagcttggcagggtacaaagggcttgtcacagccaagagtctggtgatggagccggggcctgcttgtgctgcttcctaaagggatccttgctggagagcttggggttgttcttcttctgctaggatcagagccagtcccttcagagctgaatgtgtcctagaattcctgccactccaatcaagaagatgccagcagcagataggaagtcagactcaagagagctttccaggctccttccagcccaaaaagtctttaattcctcaattgcgtaagagctggcctggccttctgcccctggcctctggaaagaggctttctcctctggaatctgtcctccactctcctgattacaacctgggctccttcagccctgctaggaagcaaatgtttcactcctcctctcaatcacacacacacacacatacacacacacacacactggggagagcacagctgagggaggaaaccatgggaccattttgtcccttccagagcccagagccacttacttttagctccctctggactgagctgtttccttccccaggtctctattgggtaaatctccaggtttggggggtctttctggttcacaaactttacaacttttcaagccattctaagccaagcaaacatcagtccctttgaagaggcagaatctcatcctgaaaagcctaaaagtgctattgggaaccccaaacctagcaaatctggaaggtcaccctagaaaagaaagggccttctgcattcatgatggctattctctccagtaggcaaccttctcattgaaatgaaaccaattcaaattaatcttctgaaaagacagaagatggttcttaaaatgtggaaatcacagctgggcgcagtggcccacgcctgtaatcccagcactttgggaggccgaggcaggcggatcacaaggtcaagagatcgagaccttcctggccaacatggtgaaatcctgtctctactaaaaatacaaaaattggccgggtgtggtgcctcaagcctgtaatcccagcactttgggaggccgaggcgggcggatcaccagaggtcaggagttcgaaaccagcctggctagcatggtgaaaccccgtctatattaaaaatacaaaaattagccaggcatagtggcgggggcctataatcccagctgcttgggaggctgaaggtgagaatcacttggacctgggaggcggaggttgcagtgaacctagatcacgccatgcactctaggctgggcaacagagagagactccatttaaaaataataatcataatacaaaaattagccgagcatggtggtgtgcacctgtagtcccagctactcaggaggctgaggcaggagaatcacttgaacctgggaggcagaggtttcagtgagccaagatcgtgccattgcactccagcctggcaacaaagcgagactccggccaaaaaaaaaaaaggaagtcacttgtaaagacttatatttcagaggtagggcagcagtgtggataagagtactatctaaagcccagtaagcaaagccacctccaaaatggaggtaaagcaaggcaacttgcagaggggagagcctggataggtgagcttaaagaaaaagataaaggccaaggtgagcggatcactggaggtgagaccagcctggctaacatggtgaaatcttgtctctactaaaaatacaaaaattagccaggtgtggtggcatacgcctgtaaccccagctactcgggaggccgaggcacgagaattgcttgaacctgattggcggaggttgcagtgagccaagatcaccccactgcactccagcctgggtgacagagccagactccctctcgaaaaaaaaagaagaagaagaagaggaaagaaaaagatgagataaggggtgtggctgattaaatcacagaccctcagatgtagagcatggcttatggttgcttagcccaattttctacttaatgtaaaaatataacaaaagcaaattttcatgcaaagtattggcagatgacaccaaattactgttgtttgaaagaagaaccaggactggattgggaaggagtgggtagatccatgctgttgataacattctagttcatggattggccagtgagctcacagatgtttgttaagttacatataattaaaataaaagagggtcttgaatggaccagtgatgagagagtgttccatgacccatgatctaattctgggcacctgaagttaaggaaaaagaaggttatgctaattccaagatactttcctctgtcctgctagagtgttacctgaatgcaagattagcatttctcaaggaaatccagcatgttcctggaaataattgatggaattatataaatgcgtcggtgcatttgttgaaacatgtgcttgctggttgcttgaggttaatgggagctactaaatattggacagcaatcagttcagaatggaaataccagatgatgtggcagagaggtcagctattttgtcactattactaggttagccttattcttgacacctccatggccaatggaaagagctctgtggaggacacagatctggacttcatttccagcttgtctacttagttcttatgtcatcagatctcccttcatcatcttatttataaagtggagtcaatgctatttgccctgcctgggtcacaaaactgctcagagggttaaattctatcatctatttggaagtgtttataggttataaaaatgtgtaataaatagaattctagttttgctctttttaaattttttacttttctttttttgtagaaatggggtcttgctatgttgcccaggctgatctcaaactcctgggctgaagcattcctcctgctttgacctcccaaagcactgggattacaggtgtgagccacctcactcaaccaacgtttgcttattttgtatttgaatttgcttccttcctctttgtcatttcccctccctgctagaattgccctttccatctctctttcccagttaagattttcagagggacctgcgcaggtcacattgcgagtctgaggatggggaatgagataggggtggaaagagagatggaaagggcaaagaaaaaggaagcaaattcaaatacaaaatgagcaaacattggttgagtgcagtggctcatgcctgtaatcccagtgctttgggaggtcaagagaggaggattgcttgagcccacgagtttgggtccatgtcacctacctggtcttcttcctttaaatcgctgtcattttcactcacccttctagaaagaatcttgtcattacattgggcaatttctatgttttgtgagggaactcaaccataaaattcattctgcaaacatgaagaatgtcctctaatttttagcctaaatttatttccccagagacaaatgtgttttcctgcagttttgtattttgaatgtctattaataagagtttctcttctgaagtccaacctttgcaggacagtttcatttacttgtttacaccacaccttgttccgggaaggatttaaggtagatgttgaggatggcatttttttttttcagacaggatctcaactctatcacccaggccagactgctgcagtggtgcaatctcggctcactgcaacctccgcctcccaagttcaagcgatcctcctgcctcagcctccctagtagctgggactacaggcatgcatcaccacgcccagctaatttttgtatttttagtagagacagggtttcaccatgttggccaggctggtctcaaactcctgacctcaggtgatccacccaccttggcctcccaaagtgatgggattacaggcgtgagccaccacgcccagcccattaattatttctcacaaaccattccaacccctttacactaagcttcgtcaaaacagaactattgttaattcttgaactctccatggtctttaatgtcctcacacttgcacataagctattcctttcccactcagccaactcattcatcctgcaggatggacttccaatgaagcctcagtgacatctcccacccttccaagagcaaagtgaggggttcctgttgcatactctcatcaccacatgaatgagtctctacaacagtaatttccacattgtattgtagttagttgactccctcagttcagaagttactcttaattacagcacccagaacagtcctggcacatatctggtgctcagtaagtgtttgtaggatccgtggatgaatgattgaatgtatagaaggatgcacaggtgaatgaacggatgtatctttcccttttctgtggacacttcacctctggtttgaacccaggacagctcttctacctactgtcctgccccctgcaaaaccaagtccccaaagccacagccccactcacctgagaggcagagaaggagtagagctgggagcagccacatgttcctgtctccttggcttccgtcctcagcaaatctaggtcccagctggaatccaagtatatgtaacggagcctgggtcatccactttctacttgtccaagtttcctttgtgttctcactcatctatttcctcttttgccttttaaagaatgcttcctaattttaagccttacttagcagaagagaaagggtggcaagagacgtttctgagaatggaccaagcacaaacaggaaaatctgttggccttcatttaatgtgaacgtaatgtttgagtcaccccctgagatttcatgactcggaatttcatgaaagtcagtcccagtttacgaaacctctccaacagagaaaactctgttccctgcctctttcactcttcttcctatctgggattacttcatcgatctaaggagcttcccttctctatggctgcctacttttgaatcataaaacaccctctacttaaggagctgtggtgatcactccccatgtctttctcaaccgttatctccatgcggatgacttcacacctcttcctctaacccaatatcccaatatctctcctgggctccagatcctactttctaacttcctatagggaagctccacctggttatacactgttaacctagttcagtatatgggtcatggtcaacagcatagattctgaagtcacacaaactcaaatctcatctccatcatttattaatcatctgaccttgggcatgttgccaaatcactctcctcctcagtctcctcatctgtaaaatagagtactcatgacaattctttctcaaagggttgccacaggaaataaatgagttaatgtaagtaaagtgcttgatacagtgcctggaacatagtaactgcccagttaatattaaatacctttagaatagtcctggaccattgaaatagcttctcatctggtccctccactagctatacattctctctaatccaacttgcacatcagaagatactcttctctaagacatagctatctgaaaatataatttctttccttctctttccccagagatacccatctttgatacccacagcctctaatctttactatcttttagaactctactggatcatctgatatttcaaacttttgttgtaagagcacaacttcttatcttttctgtaccaccatatctgatgaagtattatatagccaggcatggtggcacgtgcctgtaatcccagctacttgggaggccaaggcaggagaatcacttgaacccaggaggtggaggttgcaaagcaatgagccaagatcacaccattgcactccagcctggcaacagagagagactccatctaaaaaaaaaagaaagaaagatgaaagaaagaaagaaaaagaaagaaagaaagatagatagattatatatagaatagagccctggatggaacaataaaacaccaggaccctggtcccatgtgtgacatgagccacacacttgagggatccagaatgagcagagctgacagtagccacaacattgtgtcttagtccattttcttctactataacagaatactacaggctagctaatttataaagaacaaaagttggcaggtgcagtggctcatgcctgtaatcctagcactttgggaggccgaggcacgtagatcacttgaggtcaggagtttcagaccagcctggccaacatagcaaaaccctgtctctaacaaaaatacagaaattagccctgcatggtggtatgagcctgtagtcccagctactcaggaggctgaggtgggagaattgcttgaacccaggagacgaaagttgcagtgagccaagatcacgccactgcatttcagcctgggcgacagagagaaactctgtctcaaataataataataaaaaagaacaaatttgttcaccttcctagctttctgaagatgagaagtccaagagcatcgtagtggcatctgacaagcgtcattccatggcagaagacaagacagcaggcaagcctcctagacagagagaaaaaggggactgaactcagcctctcaggaaaccactctcacaataactaacccactccggagataacagcattaatccactcggaggactgagctctcatggcctaatcacctcttaaagacctcacatcccaatgccattacattgacagttaagtttcaacacgagtttctgagggaacattcaaaccatagcaacccttgtgccatttattcagcagagacaacagttgcaggcttcagttctttccaccaagaggaccaaacaaatcttcagccttcttggttctgcttttataatgttttcttctggttccttttttgaaaatcttatccctacagttgtttataaaataaaagaaatgggaataagcaaaggcatgtgttgatggttgaaaaactataaactcaccatgtctaatataggcacatttcattataatccaattagaaaatccaaactccgaccacctagtaagaccgagttgacacagaagctatcatctggttccaaactgaagtcaaatccaataaaaggaaattccaggtattagaaatgtaaagggaactaaaagccaggtctgtgagcaggatctgataccaagaggctaatggggaccagtcaaaatgaatttgggccttaggaggagaggggctgctgtttaaatagccactcagggacagaagacaatgtctcaggtctacacaagacagggagtgggagcagagccccctgccaaaagctaggatccatgaatggtcattacgcccatggaacaggatgaggggagaccccattgatgggctcatgggagtatcaaggcatctccactccctgtagttataaggagttaccttccatgagaacaagcacctaagttgcactacacaggggtgtgagatccaaagtacaacttcccatcgtgtgggagtgtggacaaggacgtcaatataaaacaggttggcaaatgatgagacttgtagggccatggaagagatgaacacacaccaaaaccacacctccagttcaccttgtgtttttatacaccccatgagctaatgatcattttcacattattaatggtgggaattttttttttaattcatgacacatgaaaattgtctgaaactaaaatttcagtgtacataaataagttttactggaatacagctacacatgttcatttatgtattatctatggcagctttcatgctacaacagcagagtttgttacaggaccaacgagttcatatgcccattgcactggaacaaaccaatacaccaagacaacagggtttgcagcagagaaagagtttaatgatcacagggtaaccaagcaaggagttgggagggaccctcaaatccatctccctgagaagttctgggctgggacttttaaggggattgtagagggcaagtaactggaaaattgggatcattgattggtcaaggtaggatggatgaaatcatcatgatctggaaacagccttctttggtgaatcagcttctcttggattcctctagaccagctggcatcagtagtttcactggtatacaagacctggtaaaaatatctcaaatggaaaacttaatgtctcacaatgcttaagatgttacctatggtacaattaagggggactatagtcttacaaccgggtctgtgtgattctgggggaataggcagcaaatatgaagaagcaggacagagagcaggctgacctcatgattaatgccaaatgtgctgcaagcttggtttattttcatttctccccttcccttcttccctgattaattttataaaatttataggaacaattccaagttgagtagttgtgacagagaccgcagagcccaaaaaacctaaaatctgtactggctggccctggcaaaaggagtttgccattctctggcgttgacgatggacccctccccacttgcaaccagcaatcgttcccactggcaattggaagcagaatcctgaaagcagagcactcttgggctagtcttcttgagggtaacagaagctactttaggtggtgtgaggatttaccagggcagagacaacctagagagtgatcttaggccagatggagggtccaggtagagtctagctcagccctggtgaagatacagatgctcccgcctggccccatctgcctcatttggcagccccacaagttggcactcttctgctttccacttagtgcagccccataggaccccagaagaagcaggtagctttcacctgaggacttcccctggccctctaagcagcagttcctacctgctcctccagccacacatgggatttcctacaagacaactccattccctgcccctgctttaatcctgctgtgccccatcccctcaaaacacctccaccctgactccaccgacacctcaaactcagcctgatgaacatctaacccttctctctcgctgacctccccaacaactactagaacaacagcaacgtgcttctcttccttgactccccggactgccccagcccagaacattcacctcctgctcttcaggctgtcactaaagctgctgcccgtggaactgcacagagctcaggaaatttcctcctccatagataagagaagtgagcaaattaaaagatgattcttactagctttaaggttacttctgatatgattagaatagtagaggattataaaagggagaagttcataaagaaagagggcagcgatgtgctatattaatgtatatagaaaagatgctcctaaattaatcaatttataaagacagagtatatttctgccaagaatgggaaaagtcttctgtttctcaaggacataagctggaggaggctgcacccttcaggaaccttcttagcactgtcttaattattaaacacatactcatgcaattctaatcctttaaacaaccctgtgaggtagaacttctattatccccatgtttcagaggaggaaactgaggcacagaggggccaatcaacctgctgaaggccttatgacccattagtggtgagccactctatgatggcgttcatatgaagctaggattggagggcccaggttgcctggctccaggatctgtgtccttatctcccactacccagctgcttgtagtaaattaatgcagaaacaaggcacaagaggtcatgatggttgctctgagagaattaaacagagtgatatggccaagaaccacccaggacggtctgagaagcctctgagaaggtgacgttcagaatgagactgtgctggcattcagaagagtgcaccagatgcaaaagaagaggaggcaaggccgggcatggtggctcccacctataatcccagcactttgggaggctgaggcaggcagatcacctgaggttaggggtttgagaccagcctggccaacatggtgaaaccccatctctactaaaaatacaaaatttagcctggtggtagcacacgcctgtaatcccagctactagggaggctgaagcaggagaattgcttgaacctgggaggccaaggttgcagtgagccaagatcacaccactgtactccagcatgagcgacagagtgagactctgttgaagaagaaggagaaggagaggaagaggaagaggaagaagaagaagaagaagaagaagaagaagaagaagaagaagaagaggaggaagaagaaggacgaggagaagaagaagtggtggggagggggaggggggaggggagggggaggggaggggaagaaggaaggtagtagtagtcaggagagtgaaatcaggagcacctagtgatgcaggaggaaaaccaggagagtctgggctgtagactgaatgcttatgtccccccagtttcatacattgaaaccctaatccccaaggtggcggtatttggagttggggcctttgggatatgattaggccataagggtggggctcgcatgaataaaattagtgcccttataagaagagacacaagccaggtgcagtggtgcaagcctgtagtctcagctactcaggagactgagcggggaggatcactagaggccaggcgtttgaggctgcagtgtgctatgatagtgcctgttaataatcaccacacttcagcctaggcagcatagtgaagcctgtctcttaaatttttttttaattaaaaaaaatcatagaatcatagaagagatacaggagagcttgctttctctctccctttctctgccatgtgtagataaagaaagaaggcagccatctataagccaggaagacagcccttaccaggaactgattcagccagcatcttgatcttgaacttccagccaccagaactgggagaaatgaatttcttttgtgtgagccacccaatctgtggtatctttgttatagcagcctgagctgactgagatagtctgaaagcaaagaaaggagaaagaagggaggaagaagtgctcagccgagtcaagggctgctgaggtcaagtaagatgcagaaagagaagatgcatttggatttgactgacagtaaggttgttggttccctcgtcaagggcatgtctgtagagtggtgagcagagaagacaggtgggcttgactacagagtaaatgacagatgaggaaacagagtcagaaaatgcagatggtggccgggcgcggtggctcatgcctggaatcccagcactttgggaggccaagtcgggtggatcacttgaggtcaggagttcgagaccaacctggccaacatggcgaaaccccgtctctactaaaaatacaaaaattccctgggcggtagtggcgtgtgcctgtaatctcaactactcaggagactgaggaggagaatcacgcgagcctgggaggtggaggtttgcagtgagccaagatcacgccactttactccagtccaggttagagagcgaaaccgtgtattagaaaaaaaaaaagaaagaaagaaagaaaaaagaaaagaagaaaaaagaaagtacagacactgttttataagaggctctgagaaggaaagtggagagagaggaaacaacagctggagagggctggggacaaaggggagcgtttgtttaatcaaagtcctccagtatgctgagaggtgagtaggcagatcttctggaaaacctgtcctggttgatgggcagatatctccaggacatcattgtgtgctcacagaacttgaaatccaagcacaaagatggagttaattacaacaaactaaaattactcgggtgtggaaaaaaaagacaacaacactgaaaaaactgaaacaaaattaccaaaaacatcaagagcttacacagatcaaaatgaaaaatattcaaactaaaagaaaaattggcaaacaccatcaacctacaattctcaaaagaagaaatacagatggctgacattcagaagaaaaagcacttaatctcactgaaaatcaaccacatggatatactaaaacaacaaaattataaatttttccagattagccaagaggttttctaaggtaatgctcagtaaaggcaggcaacagagtggtggaatccgtatgctgtctataggtgatgtagtgctctaattctgcaaagcaatttagcagtaagtgacaagaactctaaaaatgggctttctcttcgcccagtaattccacttttcatattctattctaagaaaaaaaaaatgaaaatgtgaacacatagtagtaaaaaatttaagagaccgtaattatccaacaaaaagaaactatctaactattgggccgggcgcagtggctcaaacctataatcccagcactttgggaggccaaagtgggtggactgcttgggaccaggagttcgagaccagcctggccaacatggcaaaaccctatctctactaaaaatatcagcctggtgtggtggcacacacctgtcatcccagctacttgggaggctgaggcaggagaatcactggaatccaggaaatggaggttttagtgagctgagatcgtgccactgcactccagcctggaagacacagcgagactctgccaaaaaataaaataaaataaaataaaataaaataaaataaaataaaataaaataaaataaaataaaaataaaaaaccctcttgagagacaatcaagataaagttctacaaactgaaattaccagatgaaaagttgcattttgaaaaatgagagaaataggtgggatttgactaaaacattagagatgaagaataatgtgagtgaaatctttgagaatgcgatgaccaaggagagaattttcccaggtccagcgtagcgcttgaaaaaacacaagcaagctttaagaagcaactgccagaaaaacagaaactgagagagattctgaaatccaggcactcgtgtggggagattgcagaagttggtggtatggctgaaagaaaatgaggaagctttgaaatgtgattcagtggcttcctgctgtaaaatcttcactgtctcctcttagctgtgatcaaatccagaccccagcatgattcacacagccctgcaggacccagcctccttccatcctcccggctcacacttttgctccagccattccaaagcacagtatttctaatttcccaaatagcagctgctccctcgagccagcacgcctgcatatatggtgtttgtcaaagcccttccagcctcccacctgccttccttgatacctggagcccctacacatccttcaaaatgccgataaagcttccctgcaaagccagctctggcagagtcgagctgctgcctctgtgcggcacagtacctgggttgcatcattctgtcttacgcccctctcccagcattcttttccgggtgaatctgccttcactgttgctttgtgtagggcaccacaggtgcggtgggttgagttaatgtgcccaagcaaagtcctgtctcatatcatttctctgtttagtcctttctatctcatttcccatttccaatccccggcatccgtacacttgtgtgattgtcaggtatacatgctggcttcgtaggagtgtgtttaagtttacataactggctgggcgcagtggctcacagaggctgaggagggaggatcccttgattccaggagttcaagaccagcctgggcaacatagtgagacccgatctctacaaaaaaaatttaaaaattagccacgcatagtggcacacgcccatgttcccagctactcaggaggctgaggcagaaggattgctcaggcccaggagtttgaggatggagtgagccatgattgcaccactgcgtttcagcctgggcaaaaagaatttatgtaaccagctttatgccatcgatctcattctggttttagctttttcactcagcactggatttttttttttttttttttttttttgacgttatctcgtcctgtggcccaggctggagtgaaatggtgcgatctcagctcactgcagcctctgcctcccagattcaagcaattctgctgtctcagcctcccaagtagctgggactacaggtgcacaccaccatgcccagtcaatttttgtatttttagtagagactaggtttcaccatattagtcaggctggtctcaaacttctgacctcaggtgatccatccgcctcagcttcccaaagtgctgggattacaggtgtaagccattatgccaggcctcagcactgggtttttaagccccatccacgttaccatggggccgtagagtttgttgactagaactggagcttgtatactacaggaggtgccgggtttacttgtcggcccctcccccatgttgcacacctgggctgcccccagctccctgctccccagacagcacagcactgagcatgctctagcctggcctctgagggcctgcatgagagtttttctgggctctgcctgcctcagcaggattgctgagtcccaaggtaaacacacacttagcctgacagatttctctccaaaaaggccacgcttggcttgtgagcgttctttcgtgaccagagcctacaatcacaacctgtttcatgaagcagagcaggcttttcgcaaactgctcccgaagtgcagtctccctttgatcctggcatgagtgtgttgggtcaggtgaaaatgcagtaagtcctcgggccttcctgagagtccccagtctaaacccttgagtccagattaaggccaagccaggatcctcggtttgactcaacagcaagagctggagccatcttccccacattccactgcgtggccagcaatgacttcttgctgtcaacacaacactgacggttgtgggggagaaggggccctgaggactcccagccacccccaattcagactccaggcttcttcctgcaatagctccttttgaggaccagctgcgctcttcacttaaagtattttgcggccggacgcggtggctcatgcctgtaatcccagcactttgggaggccgaggagggtggatcacctgaggtcaggagttcgagatcaccccagccaacatgatgaaaccccatctctaccaaaaatacaaaaaattagctgggcgtgatggcagaggcctgtagtcccagctactcaggagactgaggtgtgagaattgcttgaactcaggaggcagaggttgcagtgagtcaagatcatgccactgcactccagcctgggcccagagtgagactgtgtctaagaaaaaaaaaaaaaaaaagaagagatcttaaacaatatagggtctggatagatagtgctgtgacaagcaaccctaacatctcagtagcttaacacaataaaggtgtatttctcagtcagatcatagacaaaggaaagtcaggcagatctctaggtggcaactggaggacctgggcccttccatcagcgtcatcaccttcatgctggtttctatggtcaccatggagcatgtaagaaattgcacaggtatctaaggccaggcccagagttgggtaccagacttccaccacatccaggggaaccagacactgaggctgtctggtgggacgtcacagaaacaatgtgagcccttgtatgcctggcccttaaaaccatcccatgcacttaacgtttccacgaagatgaagtagacagacttttccctatccctcccaccaagtagaactaagccctgatcttgggtataaaacaagcatgagggccaggcatggtagctcacacctgtaatcccagcactttgggaggccgaggcgggtggatcacctgaggtcaggagttcgagaccagcctggtcaacatggcaaaaccctgtctctactaaaaatacaaaaaattagctgggtatgcatagtggcgggcacctgtaatcccagctatttgggaggctgaggcaggagaattgcttgaacctgggaggtggaggttgcagtgagccaagatctcaccattgcattccagcctgggtgatggagcaagactccatctcgaaaaataaaaaataaaaataaaacaagcatgagaagggactgaaaggtggacagacagtagggtccacggaacaatgtagcaatgagttatctgggttttctctttcctttatgtatcccagacttggagacagccctgatggagaggccaccaatgcagaaacaataacaggcacagaaaaacaacaacaaaagctgtccctctctctctagaaaaaaaaaaaaaaaacagggaacgagcaacccagcaatagagaagaacttagacaatgactcctctaccctacagaacaccccagaaaaaatgatggccccaccgcccaggccagcaaaggcagagtgggagcttagacatccacctccacccagctgtaaccaggcacccaatccccctgccaggtgctgtcagggaaggctgggtagggaacctggacttccacccccactcagcagtgagaagcccaactccctcccgcgggggtggcctcaaccaggccacatggggagtagtgagaaagaaaagggactttttatctgaggaatgcgagcccttttaaatgggcagactcagagaggcattcagatgtgacagcagtcacgtctcactccccacttgagcgaaataattgtctctggaagccacctgcgatgcaggccctagacgaacggacaccacatagccatgaacaccgtaaacaccacgcactggacgccataactcacacctgagctcaacaatgcactgccagtcaccgaccgatgtgatttctgtgaactagtaagaattcacatcagacaactccagactgtcagccccctccttgcttccttttgcctttcaaaacttgcttgtaggccaggagcggtggcttacgcctggaatcccagcactttgggaggctgaggtgggtaataatttgagggcaggaattcaataccagcctgcccatcatggtgaaaccctgtctctaccaaaaatacaataattagctgggcgtggtggtgcacacctgtaatcccagctactcaggagactgaagcaggagaatcacttgaatctgggaggcagaggttgcggtgagccgagtccacaccactgtactccagcctgggcgatagagcaagattctgtctccaaaaaaaaaaaaaaaacctgcttgtaacaaaagccaagcagaccactcccaaaggcaacttggaagtgcgtctccgacagctgtcctcacttcaactgaaattaactctttaaaattgtattttgtgcctcagcttcttcctgtaggtcttttgacccctcttggccaggggcacatcaatggaggcccagtagaagccggaattcacatcctcacccactggggtccatgaagccccacttgcaagcccgtctcaacgctgggctacgccacccttctgtatattcccatggtcccctctacatttccaccaggaaaccaggttattgtactcaccaatatccttgtctggatattggtggctgggtgcagtggcttactcctgtaatcccagcactttgggaggccaaggcaggcagatcacttgaggtcaggaatttgagaccagcctggccaacatggcaaaaccccgtctgtactaaaaaaaaaaaaaaaaatacaaaaattagccaggtgtggtggtatgcgcctgtaatcccagctactcacgaggctgaggcagaggttgcagtgaggtgagatcccgccactgcactccagcctggtcgacagagtgagactttgtctaaaagaaaataaaataaaatccgtgtatatgtggctgcgtttcttacacaacacctcacattattcaaagaaatctgagacacccaccctcacccccgctgcctcgctctcaggaaataagcacaggaaaactaaatcactgcatgccatcaatgggggagtgtgtaagtgacagcagatgtggtgcttccaatgaggccaagggatagggacgattggaaaatcccaagcaaggcctgacctgccaactacagccaaatggagtaataccttctccaaacacagacaggacttgggtggcagccactggtcttttttgttgttgttgttggattttttttagatggggtctcgctctgtcacccaggctgaagtgcagtggtgcaatctctgctcaccgcaacctcagcctcccaggttcaagcgattatcctgcctcagcctcccgagtagctgggattacaggcacccaccaccatgcccagctagtttttttttttttttttggatttttagtagagtcggggttttaccatattggccaggctggtcttgaactcccgacctcaggtgatccgcctgcctcggcctcccaaagtgctgagattataggcctgagccaccgcgctcaaactggcagccactggtctgaagcagggaagaactaggtcacctcaagtgtcctgtgagagaccacagtctgtgccgagagagaggaagtacccgtacaggccccagcataacgtccctcgattaggaattccttctgacttgcttttgttggacagcccttcctccacaattagatgagagaaacttgcctccttgtgagatgagaccaacgttatcattagacctccccatgggtggaagttgcatttgagtcctatgattccctacaccagaaaaaaaaatgattaatataaaaaaaaggagaaaggtcagaatgctcctttcccctgctggatcaaggctctgagacaggctgaaggcagaaatcctctgtcattcctgtccccttctcagctaccaggggagcgtgacccgttctggggctccagacactgttatcacagaagatttgctctttctggcaggaagcaaaaacgatgagactagtgttgtccaaactgagggttgcaacctggttgtgggtcttaagcagatttttttcttacaagtagtgtgagagaccaatggaatctcagattcccaaactcactatgccaaaggggaagagaagcttaggaactgggtcaccaatgctgtcttcctcttgttcccaaacagatggctgcaatggcacaaccctgtactcccgctcttcacatgtttactttatcttaagtcaaatgcagattaactgagctgcacacaagacatcattgacttttccctccacttcctctttccaggtgtaaaatgtagttttaccaaagctaatcagagcctcacgggaatgtaaccatttgcttccctgcctcccctccctcccttttttccctcctgctttctcttcctccttcaaagactgaagttcccggtcgggcacagtggctcacacttgtaatcccagcaccttgggaggctgaggcgggcagatcacctgaggtcaggagtttcagaccagcctggccaacatggtgaaaccccatctcaactgaaaatacaaaaacattagccgggcatggtggtatgtgcctgtaatcccagctactcgggaaactgaggcaagagaatggcttgaacccgggaggcggaggttgcagtgagccgagatcatgccattgcattccagcctgggtgacagagcaggactccgtctcaaaaaacaaaaaaaaagttcctaaaacctcctttggaaaatgcatctgtgatctgttttgttttgttttttttttcctggacaaccttggctaaacaaacctctaatgcactgagacctgcctcagtcatgttttggtctgtaacagggtatgtcaggatcaatcagagcacatctcaggttataatgataaacactgagattttattttttttttctgtatgcgtatacaagtattgccaagtaactaactttctcactgtgagtcatggtcaaaaaatactaaaagtcacgacatgggccgagtgaggtggctcacgcctgtaatcccagcactttgggaggccaaggcagttggatcacctgaagtcaggagtttgagaccagcctggccaacatggtgaaaccccatctctactaaaaatacaaaattagtagggcgtggtagcacgtgcctgtaatcccagctactcggaaggctgaggcataagagtccttaaacccgggaggtggaggttgcagtgagccgagaacacgctaccatactccagtctgggtgacagactgagacgccgacttaaaaaaaaaattcatgacatcaattatgtgtgagcattttacttcaatccagaataaagaacaagggaactctcccaccaccctctgtctcttggtgcccagaaactccatcgagcacgttctggtccagaaaaaaagagggggccctgcagtggccaaccctatgtcttgctccattcagcctgctgtaactgaaatactacaaagtgggcagcttaagcagtcatttatttcttacagttatagatgctggacatccaagatcagggtgtcagcctggtcaggctctggcgaaggcctcttctgggttgcagatgactgccttctctttccatcttcacatggcagagagggaggtctacaaagctctctggagtctcttttatgagggcactcatcccatttatgagggctccagtttcaagacctaatcgcttcccaaacccccaataccatcagcttcatggtcaggatttcaacatatgaatctttggtgggggaagaagggggacacaaactttcagtccatcatccctggaacaggcagataatgccagcattttcttcatcagtgtcatggacttggcgttatgcaagagcagtgtcgatcaggaacgggaaacaagaaggtttttgtggttatgaccgaaaccatctgctcacatcagcccatttgtggcttttatttctttttttaatactcaatttgagcagagagcaggctgagaaaggagtgctggcatcaggagctggcagcgttagaagcacctatgcagagggacaaaagccccaaagtgagcgactgctgggcttcgagccccagtgccccccacctcaccacgcccatgactcctgcatcttcctccgagacccaccctgcacagctgactcacttgccttcgtctgtgcaaataacttccccatgggtctcctttttcatttgcttctctcccctttatttcaggctactaagggatgcaacgttgacggtgctaagcagagcctagaataggagagagggctctccagaaaagacctggaacattagagatgagcaatgccactgttaggagcccatgggtcccgccctaagcctccgaggcctctccttcaccttcatatccacaccagacagggctggtgagcgaattctggaggattcaaggcgagagagagtcccctgtgttcttaacttcggggagctgaggtcacagatacacttgagattgtaacaaaagctatacacccatgccctaggaaaacacacacatacactgagtttcgcatatcctattaaaagaatctccagagtctttctatgtattcctagctaggaccccccaccctggcagggcgcggtggctcacacctgtaatcccagcactttgggaggccaaggcgggtggatcacatgaggccaagagttggagaccagcctggtcaacatggtgaaaccctgtctctactaaaaatacaaaagttagctgggcattggtggtgggtacctgtaatcccagctacttgggaggctgaggcaggagaatcccttgaacccgagaggaggaagttgcagtgagccaagatcgtgccattgcactccagcctgggtgacaagagcaaaactccaactcaaaaaaaagaaaaagaaaaaagaaacagatgagagagatatgactctgatgctagaacagaggaggagcctgcagaaggtgtgcaagcacacatgtgcgcacgtgcacacacataccagctgtcagacacagtctgtgctctttgggaaggagggtgggggttacaggacactcccatgtgacaaaacagcaatcatcccatgtcccctgggtgcataaaaacatctctctttgcacaccagcacacagccacatcttccttgctggggttctttgtgaccactgtgaaaaagcatttgccagggctgtcttgatggtacacggcgctcctctcctgacctcaggtggtccacccacctcagcctcccaaagctctgggattacaggcgtgagccaccgcacctgacccagaccctgcattcctttccccactgggcttctctaatgttcagaacaactcaaatccatttgtgcattctgctgccgcatatggaggccctgctaagtgtgagtcctactttgtgtttgcagctgcagacctcatgctgagcaagacttcgcctggccctggaggggctccccactacaccctgggttgcctctgtgccctctggactaccaggcctggcttagtcgctttccttgggcctctgtttgttatcagcagagcccacccatctgaggctggagcctgaaactctagtcatccctctgattccctcatcctctccccagtgcaccccagccccacccacctccccttccccagccactaggcctgctgttcctcatgctcccaccagcctcccccaccccactccccggacccaggatgtccaggaggggcagatgtgtcactgtgtctctttgctctctctgcctcatctgccaacatttggggagcttctgtcagctggactgaaactggctttcatgtttcttactactcccttgcgtctctcttttctacacctcagttttgttgttttcccattgcatcaatgtttatacgtagagctgttcagaaaaagcagaagctggagacaggaaaactactaatcacaacagaaactttgtggctttaattctcataataattagcatcacagggcacccacccagtttctcaagagcctacaacttccaaaaacagacaagttaagtcacatttttatgtatcattgtgtcttcaaatatactaatccagcagatttatctgacatcaaaacagggagttggatgttcagagggcaaatcttacccaaaaattgctgacacagcccctaacatgttacattattattaattggacagtcacttaatgagcgtctactaagtaaaggcgctgtgtatacaaagaagaaggagagatcatgattctgtcaggatcctgggagtgggccaatggcaggctcagttggtataacagaataatctaatgcaggggaaatttacaaagagaaggaaagagttaagtgaaatcaacaagagatggagaaaaaacaggactagcaacagcagtagggccacgacacctctaacacagggagaggtgtcagaaataaccagaacccacaggaactgtaggacaggaccatgccacaggggctgtgacctcaaagtaggaaaacggacactccagcccagcagggtggcacctgggcaggagaaactctcaccttcctttctcctgctggcaccacccattgccattccttggaaagaaaataaatcttgggaccccaaactcactaagccaaaggaaaaagtcaagcagggaactgggtcatgcaaacctacctcccatgttggttcctaaatgagatggtgacaaggatgacaggctaccaacctccctcacattgtggtctttaaagcgtttctgttaaatttccccatgccaatgtaaactgatagcttatcttcacaggtgcgagacacaggacagaactcaaagtcattcctctgcccacctgagacaaacgcatatctgactgtttcctctgccctgttgtttacgttatcttaggtaaaaatgcagattcactgagccagacaaaggcctgaatggctattttccccacctcccctctcacaagaaaattgtgtatttctcaatatcccacgctttcccttttaaatattgaagcccccaaaatcatcttcagagaaaggtatagacctgtctcccaggcgcgtttccttaactttggcaaataaacttcctaaaatgattgagacttgcctcagtcattttcctccattgacaacctgagcccaaccagaagccagagtgaggttatctatgttcccctctccaataagaatagaaacccccactccagagcaggtgcggtgtctgactcatcttcatatcccagcagtaagtacagtgaccagctcaccgcgggtgctcagtaaatgcatgctgtgtgaagagatgaatgagtgaatgtccgtccactcagcaaccttgcagccaggtgtggttgctcatgtctgtaatcctaacattttgggaggccaaggcgagtggatcacttgagaccaggagtttgagaccaacctggccaatatggtgaaaccctgtctctactaaaaacccaaaaattagccaggtgtggtggtgcgtgcctgtaatcccagctactcaggaggcttgaacccaggagatggaggttgcagtgagccaagattgcgccactctactccaacctgggtgacagagcaagactctgtctccaaaaaaaaagaaaaagaaagaagaaagaaagaaagaaagaaagaaagaaagaaagaaagaaagaaagaagaaagaaagaaagaaagaagaaagaaagaaagaaagattcttacaaactataagatactaaattatctaaaattatttcaaaataaagaaggaggttttgatgctatatgcaggtaagaaaggttggaattaatctctggaataacacacatgattttctcaattcctgtactaagcacatatgcatggctccagaaataagcagaaagtctttgccatttcaactgtcccccacatacttactatgttaacccacttctccatcaacacttctgccccaggcaactagaagagagagaaggaaggtggtgaaaagcagcttcatggttctgcctactgagctctgctctcccctctatacagcccagtcctcctagactctgggctgaccatgctacagagagcaagtgctgcatgctctgccttctgctttggtgcctccctatctcttcttatggtggtctccattcacacctgcaatcattgtttattctactgcttttttttttcttttaagaaagaaactgagatgataagcagcaactacttgacaagcaagtgttcaaacacaatgctatggcaatctcctcaacatgcttgaaatatatgaaaagatagaaaatctcagcaaggaaatagacacaaagaagtagcaagtggacattttacaaatgaaaaatatgataactaaattttttaaattcagctaatgggctcaacatcaggagggagaggacagaggaaagaatcggtgaacttgaacacagaacaatagaaattgtctgatctgagcaaaagagagaaaatagactttaaaagatgaacagagccttaggtagctgtgggactgtaataaaagagcaaacattcatgtcattgaagttccagaagaagaaaagaaagaaagcagagttgcaaaaaggtatttgaaaacataacggctaaaattttcccagtttcagcaagacataaagctacagatcccaagataactatcctcaaagtcagtcagagcctgggtctaaaaaccattttgagcagattcctggaaaactcaatctccagtccaaacattcttctaacctcagacctccttgccatccctctccttgatatctgcacttgagccgtctcaaagatgcatccaactcaacaagtccaaagtaaactcacaattatgccctccagaaaggagtcccatcaccttacactgtttcctagttttcatccctgacccctctgtgtcttcatccccacactctgtcctgcctggagcccattcaatgttgcctcctgttaaagctctcagatttgtccatctctctatctccttctctgccaacctagcccaagctaccatcgtctgtcaatagcctcccaggtggtctgcccacgttcactcttagtttttcgccactgtgcagccagaatggtatttttgcaaacaaatctgatcttgccactccccctgtaagaaacattaacagcctcccagggctcttacaactcctctactggacctcagtttggcccctgctgacctcccaagcctcaagccataataacctcccacttaatccccaaggggcaaccacaaagattttggttcctcagacagaacacattcccttgattacagtgactgttcacacactgtttcctgggcctaaaatgctcctttcctctctttgcttggttaactcatactcttcctccaaatctcaaataaattatcattcattcaactcaacaaatatttactggacacctactacatgccaaataccgtgctaggtgctggaatgcagcaacaaacaaatcaagcttctgtcctcaggaagcttacattctcctagggggagggggagaggagaaaataaacacatataaaatgtaccaggtggtcataagtgccccgaagacaaaaagggtagagggagtgaggggaggcaaatgctattgtattaatatctatagagaaggtatctatgataaagtgttatcttattttaacagagacctgaaagaagggtgggagccacactgacagctgcaggtgaagagtgcaaggtaggccgggtgcggtggctcacgcctgtaatcccagcattttgggaggccaaggtgggcggatcacgaggtcaggagatcgagaccatcctggctaacacggtgaaaccccgtctctactaaaaatacaaaaaattagctgggcaaggtggcaggcgtctgtagtcccacctactcgggaggctgaggcaagagaatggtgtgaaccccagggggcggagcctgcagtgagccgagatcgcgccactgcactccagcctgggtgacaggagacaccatctcaaaaaaaaaaaagagtgcaaggtagagggggctgctgtgcaaaagtcctggggtgggagcagaggccaccatggctcaggaagagggaatgagggcaagagtggaatgagacgagatcagaaaggaaacagagtcatcatttaagggcccataggccttaatagggagttggatttgactctgaatgatgcagggagccattggagaattacgtgacctggcttactttaaaaggatcacacgggctgctgcgaggaaaaaacaattgacagaggtaaggcaggaaactgggagacatgaataagcaattgtagccttccaggtgtgagacaacggtgggctaggccatgtgggggaagtggatggggtgagacatcgctggagcccagttgaatcaatgcccctaatggaagttcccagagcacctccttcttctatggtggttgtaatgggacatttattggtgcacatttgattaatgtctgtctccccctactgggctataagcctcaagaaggcaagaaatgggtcttctttgctcaccattgcatttccaacatccagtgcccacaatatatgctctatatagttttcttgaatgaatgaatgaatgaatgaacaaataccccaaaaacaaaagcacaaacacacaatcctttaagtctacttgggaagcccagccttccctgctctcttgaggctctgcaagaagcagtcatgcaacatccactccatgcccagcaccttccaggcacaatattaaagaagtgcaggggccaggtgcagtggctcacccctgtaatcccagcactttgggaggccgaggtgggtggatcacaaggtcgggagtttgagaccagcctggccaatatgtgaaaccctgtctctactaaaaatacaaaaattagctgggcatggtggcaggcacctgtagtcccagctactcaggagactgaggcaggagaatcgcgtgaacctgtgaggtggcagttgcagtgagccaagatcacaccactgcactccagcctgagcaacagagagagactctgtcacaaaagaaaaagaaaaagaacaagagcagggcagtgtgacatttgctacccaggttcaggtccagggtctgccagccatggccagagacataataattgctaagaattactgagtttactttgtttcagagaccactttagatgctttctgttattactttgcttaaatcccgtgcaagtcaaacaaagtaggtattattattattatccagatgcataaactgtatggcacaatcacacatccctgggtcctcccaggagggccaccacactctgaaactccagtcttttctatttttcagagacggagtctcactctgtcgcccaggctggagtgcagtggtgcaatctcagctcactgcgatcttcacctcccaggttcaagcgattctcctgcctcagcctcccaagtagctgggattacaggtgcccacaaccatgcccagttgatgtgtgtgtgtgtgtgtgtgtgtgtgtgtgtgtgtgtttagtagagatggagttttgccatgttggccaagctgatctcgaattcctgacctcaggtgatcagcctgccttggcctcccaaagtgctggggttacaggcatgagccaccgcacctggcctgaaactcctttccaaacctaagtttagatttccaatgccactgaaatctcacctaaattcagggcaatcagagggagaagcttctacacaccccaaatctcaggctgtctctccatctccttcccttggtcaagtggcaacctcccaaggacggccacaaggcacccagagcccagctgcagagtccactggctctgtgggagtcctggagataaaggacaccaccgtcccctctcagatgccccaagctaaatggacccagcaaagcctggcccagcagctccaactgctgtctgtggggaagctggctgaaagagctccggggcaggctccgtgtcttatctgtcctgcaaatccagagctgtgggtgccaggagccaaagcctcatttctgagcctggtttgtgtcctagcttagcccagatcctaaaagtcaggagatgaaggaatggccatcattcttcttgactcaactgcatgtttgagaactaagatgccaggactcacagtgacaggagaggcagtgcagtcccccagtgcatagcagctgcaccctgaggctggtgtgtctgagcaaagccaatgcagagctgcgggccctacagatcccatggggaaggagggagaggggagggcaggggagggtagcagctgaggagggttctcactgcctcgcctgaagctgaaacctagcatccagtgggtgatagtgcctggcacgttgcatttcccagggatggaaaaatgtacttttgtcccctccaatcagttggaggtgtgcctggaaaagtgagttgagaaggatggggctgagcttgggcctcctgggctatcacagccactgagtactgagtgaagagtgatggctgatgagagagggaagcgagggtgggtgtgcgtgtgccaggctttcacagctccagagctgagctgctccagagctcatatcgatagagacagaataacttcatccacaggattctgcctgctgagaatcagaaacaagttccctcttcctggccagccatgccaagagccctcagctagacccgtcaggattctaggtccctaaggggcacggagcctccatggactgtcctgtttgtggttttagcctctgggaacagttggctcccatctgacccagcagcagccagaaaacatcaccacacttgatccaagaacccaccgttggggccaccaggcaaccaagccaccaggctgaagttgcaggcagcccctagccctctctcctcacctctccgtcaccctcttcctcctcctttcctgccattcgccatctatcaaaataaaaactcaaattttaaggacaaatcctagaaaatgagtgaatacagaacatcagggaagaggaatgtagcattagttttatcccttaggccttgagcattgatgagtttaaagaaggaaaaatcaagaaggaaacttgagtgaagagaggcaacgaatgggggaaaagctgggcaagatgttagaaggaccggattctagtcccagttcaccactcacctggggcaccagacgtcactgttctcacctgaggtcctggttgtgcatagggttgtctctgggcattggaggggagaaccagggagccggcccccaggaccacccctgcatcacttaatgcagcttccagattacattttatttttagtagagacggggcttcaccatgttggccaggctagttttgaactcctggcctcaagtgaaacacacacctcagcctcccaaagtgctgggattacaggcgtgagccactgtgcctggcctccagattacgttttatttcaacaagagtttctgcaaccaaaaaaattagagtattaaatattttctacaaagagtatatacgacctgtaagttataaagaataataaaatgcacacctatgtgcccccacccagcttaagaaagagaataactttaatttttttatttattttttgtttcctgattcaaatgtaacatatattgactatagaaattttgcaagatccggaagagagaaaacaagtatcaccacaacttcattatctttttgcaaacattctggtgacaattctttcctgtttatcctgggtgtgtatcttttttctgaaattgagatcctatggtgcaaattgtccccttttttccatcatggccatcttccttggatcagctaatttcttggcaccctttcacctccaagatttcaagttaaaaacccccggattttttgtgggagtgggattcagagttgattttccaaaaagaagcagtagtaggaattgacagattggggaaaatctgtcctgtctggcttctacctgaaacatacactacattaagaggttgataaagtgcatcctgtcatatctcgcccagagcggtatctcaggattaatgttgattgatgtttgtgtctcatgaggctgaaagcatgaggcatctctggagataagaaggaaaatgaaagccagtgctttcaggattaaaaaaaaatgccttagaaggcttccctgcagctccaagccaagcaccggggcctgtgatagattctcagtacacactgcgtgcctgtatctcatcgttgtgcctgttcagtcatcatttatccagaggataaggcacggttctataaacctacctagaacacactcaggcaaaaggggacatacattagaggaatacgaggctatcacccatcattcaaagaaaatccatgggaaaggcaaggatcctgttgggtgtcggggtcaactggaaccgggcaatcaaacagcccctgggttctctcttccttgtcctctctgggctctattctctcaccctagagacagctttctccaggaggagggaaaatggccactgacacctctcacgttttccatcttaggagttttattcccagagaaagccttacttccttccttagcctcagttaaaagtaaaaagaaaccctgcctgggaagaactgagattggcctgactttcatcaagtgcccaatcctggaccattccattgtgtccagggtcactgaaagtggcagcacaccccactgaattgcagccatgcagttaggggatatctgagcctaagagcagtcgctgatcctaagcaggagttgaaatcatgaaagtggctgcaaatcacccagtgagtgtatagaaggaaaagaagaaagcagggcagaacactgggcgtaaacacaatttaaagaatggaaagaagacaaggaatccaggaagaaaagtgaaaatggctataaaaaaaagcaaataggtggaaaatccagacagcacagagccacaggagccaagaaggctggagtttggaggaggacggagtacccaccagcatggaagtccaggaaaacatgcaaaggagaatggccctggggtctggaagcaggaggggcactggtgatctctgcaaatgccatttccgtggagggtgggagtggaagccaggtgaagaccagcaaatacaacctgagggtagttcttgaggaaaatagttagggaaggtgggaaaggtggaataggaagcgggagaggcagaggagacagtcccttccaccttaaccacatgggtttatagatcagacctcccttgacaccaaaccctttgcatgcaatcccctgttattcaatccaatgtcacattaaatgtccatgctatacactataagaaagtatttctaataataatagctaatacttataataaatcacagaggcctgactcaagctcacgttctcacctattctttctgctccttccccactggtccactaaagtaaaggagtacatttttttttttttgagtcggagtctcgctctgttgcccaggctagagtgcaatggcacgatcttcagctcactgcaacctctgcctcccgagttcaagcaattctcctgtctcaccctcccaagtagctaggattacaggcgcctgccaccatgcccagctacctttggtatttttagtagagatggggtttcactgtattggtcaggcttgtctctttgccaggctggtctcgaactcccgaccttgtgatctgcccacctcggcttcccaaagggctgggattacaaggatgagccactgtgcctggccagtaatggggtaatttgtctagagggagatgatagagcaacagaggccagctcctcccagacttacagccttcccctaagaaaaatgagtgctctctccttctatttctaccaaacatctacctccattctaccaacactctctcccagctctctgaaggagaaataaagccctgtctgagttatgtgtggaggcacaaccattagttttggacaaaacagcaattctagataattgcaatgttcagggtgtctgccccctacccaatggcccctctctggagtccaaatctccccttctctgcttcatgctgtaggaaactgcagaactgacaatgaggttatgaaatgcctgggcgtataaaaggcagacagtgctagactccaggagactattcaaggctggctttatttagtgtgtcccacagccactaattgccgggcagatcctgatgccatagctgatagaacagcacaaggcagctaggacacccgcaatgtggccttctggaaatgggaccaaaagcccattctcataacttgtcttaaaagtaggttcccctctggttcagccacaaccactgctggtgacctcacttcaaacctggctgtgctgcactggggctgctgacacacacctgactatcataagtcgctgtcctttgtcatattcttcctgctggtgcaatatttttcttcctgcctatggcctaatttttagggcaggaagatgaaaataagaccttccatctgttcccacttctaaaatattaggtgtaaagaaatattctctctgaattaaaaactttccacgttgaaccactaacttgaaagttactctttacttttttctttcccctttcccctcttcttttcttctcctttgattcctttttactgaaatccatccccagcctctcctctctctccacattacccccatccctcttcttcagttccctctattacccatcttctctcctttccatggtccagaccacagcaaggcaaaaaaggcacgtagggcacaaaatctaaggagtcttcccgaggtgcaggcatgaccctgagagtgactgtccgtagacacctttgtcacctcgccctagatccagcccttttccttccctatgtctcttactttacatcattcaaataaggatttgtcttccatctctccctattcctttgctcttttggtcacctggtagaatgtttattccttatacatgtaacaactatattatctagaatactcattcagctactgtattgaaagccaacttatgtagggcatacacaagatagaaatctatttatttttcctccaacattcaggggtaagcagttcaaggctgatatggcagttccacagcctcagggttcttccagcccatggctctaccatccagcactgggcttccatctcagcatcagatggctgctccagcacccaccaccacccctacatcccacccagaggaagggaagagaggaagaggagggtttgctccaatctctctctgggcttgacttctgctctcacatcccgttggccagaattcagttatgtcgccacacctccctgcaaaggaggctgagaaatgtttttaaattttgtgcccagccaaaaattctgttactgaaaaggggagagttggaggataactagaaatattttccatgttttatcgtactgagaaattgcatcttttcttactcgaaatattagggagaggaaaacaatagctatccctctcctattctttttcttaatagtgctgcttgcattttagatgaagtgcatttacatgcacttgtataataagtggaatttatggcagaatagtgacgatgttgatgatgatgatgacgaagacaaagacaaagatgaaggcaacagtcgacacctacatatcactgtctaagtgcggatgctattattctaagcctttttatgaagccctccatattaacccactttacccttacaacaacctgagatatacattattattatctctattttacggatgaggtaattgacacagagaagttgcagtgacagagccagtaagggatgaatctagattcaaacctaagtcgtctggctctagagggaaacactgtaaacaatataaatagatgttattcctggtggtagcactggaatatgttgcacagttttaggagaccccatggcagatggcaccatgctgtgctctggaggtgacactggggtcattaacaccatcttctacatgaacgtgcaatgtggcggtctaggtcatgtccttcctcctcccctaataagtctagactctcttcttaattctgtccagtgctctcctcctgcgcaactaaagttcttcttcatctcatttgggaaactaaagccctttctgaatggttttccagggcacgttgattgatgccatcagttcaggagttcctgaacttgtcttcatgtcagagtcacccttagaaccttataataatgcaaacccccaagcctcaccccaggatactctgaataagaaagtctgggctcggctcagtggctcacacctgtaatcccagcactttgggaggctgaggcgggtggatcacgaggtcaagagatggagaccatcctggccaacatggtgaaaccccatctctactaaaaatacaaaaacttagctgggtgtggtggcaggtgcctgtagtcccaactactcgggaggctgaggcaggaggatgacttgaacctgggaggtggaggttgcagtgagctaagatcatgccactgcactccagcctgggcgacagagcgagactctgtctcaaagaaaaaaagaaagtttggggaaatctgtatttttgatccctgatatttgaagtctgtaaaggaaaatagtagtatattcattattatgttcaattaatattaatatgctgaatctgatattgaatctcctctgcagtgtcccaccctggtgacactcagcctttgtacagtgctcacactagtcccaggtctgcaacagcagctcacattgactgagtatcccaggcaccgggacaaggatggatggatgatctcatcaaatccacccaaaatccctcagggctcagtgcaattacccccaaccacagggaaacagactccaaacgttaagtgtgtgcctcaggtcataagctagtaagtgaagtgctctggtgcatgtgggcctggtgtgctgacttcaaagtgagcatgatcacctgccgtgcagtcctgctcctgggctgcagcacctcctcccagccgtgctttgacctctcctcatttcttatacattattcctttttttttttttttcgacaaagtctcactctgtctaccaggctggggtgcagtggtgcaatctcagctcactacaaccttcacctcccgggctcaagcgattctcctacctcagcctcctgagtagctgggactacaggtgcctgccaccatgcctggctaatttttgtatttttagtagagacagggtttcaccatggtggccaggctggtctcgaactcctggcctcaagtgatctgcctgtcttggcctcccaaagtgttgggattacaggcgtgagccgccgcactggcctccatttttaaaatatgaaaactgcaactcaaagaagtcaagaaagtggtccaagtcaaataacttacaagtggctcaggtagaccttgaaacacatttgtctgagccaaaatcccagtttcctctccataagtcacacggctttcctgcagagccccgcagcctcacgacccaaccatatgtgacctcagcataggcaacacatgcagctgaccttaaataaatgcttctggccggatgcggtggctcacacctgtaatcctagcactatgggaggcagaggcgagcgaattgcctgagctcggcagtttgagacgagcctgggcaaagtggcaaaaccccgactctactaaaaatacaaaaaaaaaaaattggctgggtgtggtggtgcacacctgtagtcccagctacttgggaggctgaggtgggaggattgcttgaacccaggaggtggtggttgttgcaatgagctgagatcacgccactgcactccagcctgggcgacggagcgagactctgtctctaaataaataaattaactaccgcttctcacatgggaagatgaagagaaactcttgcacacagacaacaggagacatgtatgtgaaagttccctgcagtgctggtcacagcagataaaaaccaggcacagcacacatgcccttcagtggaagaatagatgaaagaaatgtgggctattcactcagcagaacgttatgcagcagccaaaacaacagacatgccacaatacagaagaatctaagcaacgtaatcttaaatcaaaaaagcaaccagccaggcacattggctcacacctgtaatcccagcatttagggaggcagaggcaggaggattgcttgagcccaggggttcgagaccatcctggacaacatagcaagaccccatctctacaaaaagaaagaaaaggcccggtgtagtggctcatgcctgtaatcctagcactttgggaggccaaggcaggtggatcacctgaggtcaggagttcaagaccagcatggccaatatggtgaaacctcatctctactaaaaacataaaaattagccaggcatggtggcacatgcctgtagttccagcttctcaggaggctgaggcaggagcatcgcttgaacctgggtggcagaggttgcagtgagctgagattgtaccactgcactccagcctggacagcaaagtgagactccatctcaaaaagaaaaaaaaaaaactaacattttttaaatgcatctttaggaatgcatatagatgcaataaaactacctaaaaatgaaagcaaaggattgatggacagaggaatcaggatgattctcaatttggggagtgaagtgggatgagtatatggttaaatgtaggttattgccaaggccctagcttttgctttgggtttacagagccttattacattggaataaaccaatgaatgaaagtggactgtccacgggtgaatgatgagtgtctcagaattccattatgatgattgacccaattctgagcaccctgaggtccaatttaaagaaaagctaggttaaccgatgaagaaatgatttggcatgatgcattatcagctcttggaaggagggattgaattttcttcctagttttgatcctcagctatgtgccttgaggaaaacaatcacgaacgacagcacaaaagagcccagagagaatacgtgaacttgaacccactgatcactgcgagcagggcaggttgtttaagaggggattccatggccaagtgaagtgtgacttcagcaaacgctctcaaaactatgatgcctcccacacagagagcacacatgtgtgcatgcgcacacaccagccgctgctatggaagaaaaacacctgtaacacccacagtccaggagaaaacctgaagagcaaatgcttctgcaaaggtgacatgtgcatttaaaatcacagtatgatgcaaatgacatatcttctctcctaaaagtatatttctcacatggaaaaagggctatgccacatgagagagaggaaatagagcagaaagagtggctgagagaagtccaggtaaattttgctggctttttataattcgactggccctccctgaagactgggcaatagaatttcctcctccctggggctgttgagcttgtcaattctctgatgacacagtcaccaagttctgagaccctgctggagacaaatgtccacaaggaggaggcagcgagctgcaaagagcctggcactcagtgaaggagcctgcctagacgcagcttctcccacagcctgcagctgctgttctctgtgctacaggagagcactaccgcgctgatgaccattagaaggaccacacgctgaagtcccagctacttgggaggctgaggtgggaggatcacttgagcctaagatgtcgaggctgcagtgagctgtgatcactccactgcacaccagcctgagcaacagagactcaatctcaaaaaaacaaaaacaaaaaccaagaaggaccacaaactcccggagtcctagcccatggggatagtcggatagtctctttctctttctctctgtcttttttctttttccttttttttttttttgagatcgagtctcgctctgtcacccaggctggagtgcaatggcacgatctcagctcactgcaacctccacctcccaggctcaagcaattctcctgcctcagcctcccgagtagctggaattacaggtgcccaccactatgcctcgctaattttttgtatttttagtagagacggggtttcaccatgatggccaggctggtcttgaactcctgacctcaggtgatctgcccacctcagcctcccaaagtgctgggattacaggcatgagtcaccgcgaccggctccatgggggtggtcttaatgccacaggttccaggtaagagtggctattgtatgtcccaggaatgagggtgttggggcagatatggcgatgtcactgagcactttctgtacacttctggagaggcagacccccttggcgtctcctcctcctgatcctgactgagtggcaggataggttggaacttagcgtcaagaaagttcagtgtgccagagagtttttccaactatggagctaaaagcaccaaacaaacctccacagtcccttcctgagccacagttctcggctgatgattctataagcagaaggcagctgcaggatggcggaaagcgtatcaacgtggggccagaccactagggactgaatcttggttctgtctgccgtctgcaggatcctggtgatgaacttaatgtcccagactctcactttcatcatctataaaatgggaagaattatagcctcctccaggggagtattggataagattaagtagataatacatgcaaaagagtcgatgacatcatgcgacacattggtgtcacaataaaggttcacttgttcatcatgcatccttgtatctcccggaaagcacccaatggagaaggcaaacgacatggcagcagaagtctggcatcatgggcagggcctgggcggccttacagaggctctctcttattagaggctgcttctcaatggtcaaaaaggtggctccttgggatgctgggacaggagaagttatcactgggggacttttctagggaaggaaacgtttgtgcctagtggccacttcctgggtgaagccctccccgagtcccaccttcctcctcacctccaggcagagcaagcggtcatcctctcctccagacttctggcacgctcatgttattcacaatgacagctcccatattgagcactcagtatataccaggcactgggcttagcacttaccatgcattctttctttctttcttttttttttcttttttctttttttttttttttttgagacagggtcttgctctgtcgcccaggctggagtgcaatagagcaatctcggctcactgaagcccctgcctcccggctgaggcgattctcatgccttagccacccaagtagctgggatgacaaatgctcaccaccacacccggctcatttttgtatttttaggagagacgaggtttcaccatgttggccaggctggtctcgaaccctggacctcaagtgatccacctgccttggcctcccaaggtgctgggattacaggcttgagccacccaggcccggccgcattctttcatttaatcctcataatgacactttgaaagaggaaagtgaagattagcaacatgaaataatagacaaagctgcacagataacacacagtggagtcaggatgcagacccgggtctgctgggtccaagcttgagctttcagccactgcactacaatgcctccctcatgcaccatcatgacccttatcccatgatatgatctttctgcacctgttagtcacaagcggtagactgtcggctgtttagagtcaggaactgtagctcttttgtctatttatcctgagtgcctagcacagtacctggctaagaatgaatgaaaggaaggaagaataaatgaacagatcttctccaaagccccaaggaaggagacagcaccattgttcctcctaggtcaatacaactcaaaacctccattcccatccaagcatgccagagggggaggggataggtggctgcatatggaggctgccccttccctgcagtgcacccctcacccattccaacagcccagagcttagtcatgggagaaacgttgcagtgaaccgagattgcgccactgcatgggcaaccaagcaagactctgtctcaaaaaaagaaaaaagaaagacgacaatattattgtattatattgtattctttctaagattacaatgtaatatattgtatttaatatattgtatctaagaataaatattatatactgtaagaaaaagaaagttatctaaatacaaagaagccatcctatataatattatttattaatatataatatcttattctcaaatacaatattgttcagccttagaaagaaattaaattctgacacatgctacaacatggatgaaccttgagaacattaagctaagtgaaattagctagtcacgagaagaaaaatgctgtgtgattccactcttatgagatacctatattagccaaatgcatatagacacagagagtagaaaagtggttgccagaggctgggtggaaggggaatgaggagttgttgtttcatgggtatagagcattagtttcacaaaacaaaaagagttctggagatgagttgtaagacaatgtaaatgcacttaacactactgaactgtacacttaaaaatggttaaaatggtatattttttattacgtatattttaccacaattttaaaaaatttaaaagagaacaaatatatatatatatatatatatatatatatatatatatatatatatatatatatatagttgttgttgttgttgttttgagacagagtctctctgtctcccaggctagagtgcagtggcatgacctcggctcactgcaacctccacctcccaggttcaagcaattctcctgccccagcctcccaagtagttgtaattacaggcacatgccaccacactcggttaatttttgtgtttttagtagggacagggtttcaccatgttggccaggctggtctcgaactcctgacctcaagggatccacccgcctcagcctcccaaagtgctgggattaggcatgagccaccacacctgggcaacaaaaatataattcttggaaactgaaaagaattttgctaaaaagtaatgcattgtaagtattttaaagatgacagtagggaaatatcctagttcatagagcagaaaagacaaagagatggaaaatgatcatatctgactacttgggaacttcagaaaatacagtaacaattaaggggagaaaaaaattaaatcaagagaatttcccagagaggaaaggagacacacatcttcaaattgaaagggtagactgagtacccagcacaatagatataaataggcatatggttatataaattcatgcagaatatcagaaacccatagattaagaaaagattttagagggcgggcacagtggctcatgcctgtaatcccaggactttgggaggctgaggtagatggatcacctgaggtcaggagttcaagacagaccatcctggctaacaggatgaaaccccgtctctactaaaaatataaaaattagccgggcgcagtggcatgtgtctgtaatcccaggtacttgggaggctgaggcaggagaatcgcttgaacctgggaggcagaagttgcagtgagccgaggtcacaccactgcactccggcaaagacagagaagaaagaaagagagagagggggagggagagagggagggaggaaggagggaagaaatgaaggaaggaaggaaggagggagggagggagggagggagggaaggaaggaagggaaggaaagagaaagagagaaagaaagaagaaagaaagaaagaaagagagagagagaagaatagaaaagaaaggcttccaaagcaaaaaaatacatactaaatactaaaacaggccatccccaaaggcagaggaattagtctggcaaaagactttctatgagcagcacttcaattagcaatattaactcctaagagtatccaggaagacaatgcaatgatgtcttcaaacccccgagaaagagccttcaacctggaattccaaatccagcccaaattgagtaggagcagaacaaatacattttcagatatgtaaagactcaggaagttcacctcccatgctctctttcttaagcaattatttaagtaaattcttaagtcacttctttgaatacttattcatgaggaataaagcaagaaaagtaaaccaagttcatgagagagtagaccaagaaagcagaataaatgagccacagaaatactgaatccgtgtaagaatagaactaaaggaaaatgtcagagctatagctacgcagcaggcccagagacaaccagttcttggaataaacagatagaacactgtgtcagagaggtttgtgagatgacgtagatgagagcttagaaaatgagccttgagcatctgttgaagtccctgaattcaatgtttaaaaacaaattagagccaggaacagtggctcatgcctgtaatctcagcactttgggaggccaaagcaagaggattgcttgagctcaagagttcaagaccagcctggggaacatggtgaaactccatttctgcaaaaaattagccgggcatggtggctcatgcctgtggtcccagatattcaggaggctgaggtgggaggatcagttgagcctgggaagtcaagggtgcagtgagccatgttcgcgccattgtactccagccttgatgacaaggtgagaccttgtctcaaaaaataaaaatttaaaaagtaaattagaaactcagggggaagaagtaaaacaaagtcattatctaatacaaagaagccaatccatatcagaacacaaagtcactgagattcaagaagagaatggaatgcataccaaagagtggaaaactggaagatatgaggaacataatgaagaagacatgcattttctttctcaacaagcaaaaatagaggcaatcataaacttaagagaaaacaataagtatataaaaagacaaagcacagattaaaactgtgccatgattttgagcaatgggtgtattattaaaaagagtgagcataatgtcataccttaaattagatcctggatcagaattaggaaattgggtaaaaacttaggaaatgcaagtgaaaaatggccttccataatagtgtatcagtattggttcatagctgtgacaaagacaccataataatgtaagctgttcctagcaggagaaactgggtgtgggatacacaggagctctctgtactaactttgcaactcttctacaaacaaaataattctaaaattaaaaaaaaaaaattaaaaagccgggcacagtggctcatgcctgtaatcccagcactttgggaggccaagataggcagatcacccgagttcaggagttcaagaccagcctggccaacatggtgaaactctgtctctactaaaactacaaaaattagccgggtgtggtggtgggtgcctgtaatcccagctactcgggaggctgaggcaggagaatcgtttgaacccgggaggtggaggtggtagtgagctgagattgcgccactgtactccagcctgggcgacaagagtgagacattgtctcaaaaataaataaataaataaacaaaatgaaacaaaacttggttttttaaaaaagtatatctgaaagaggttgggaaatgacaggggaaagaagtgaaaagaaggataggaatgctaatgattcatcttagaccttggcaactccaaaaatacaatctacggttcacaaagcaaggaatggaggttggagtctgctgtgtgaaattgcagagttgactggtggaaaaacagaaaatgggggcataactatattgaaaagactgtgcagaggaaatataagggtactagtcaacagatgtttgtaactgttagaccaaaaaaaaaggcattaaaggaactaaaaacagacagagctaaaaaaaaaaaaaaaaaaaaaaaaaaaaaggagcgggggcagggggaagttaccttggaggagaaggactctgggtagggataagagagacgtctaagcccttccataccatttaaatttttgcatatgcatttgttactttgattaaaattttcaaaatgaaacaaacaaaaaattgtacctatccagttcacatcatgacagatacggaaacagaatccatcatagtgattacaattctcaaacaaagggctgaaagcttctgtattaacatgtaaaggagcactcttggcaggtgcgatggctcacgcctgtaatcccagcactttgggaggccgaggcaggcgaatcacgaggtcaggagtttgagaccagcctggccaacataatgaaaccccgcctctactaaaaatacaaaaaattagctgggattggtggtgggcacctgtaatcccagctactcgggggactgaggcaggagaaatcacttgaatccgggaggcggaggttgcagtgagccaagatcatgccactgcactccagcccaggcgacagtgcgagactgtctcaaaaaacaaacaaagaagaggaattgaacacagaaaagtcaatattcacaccctgatagctaggactagaagaggaaacttagagacacaccttaagactccatatgccagaaacatttcccaggcagaggtagctgaggcaacaggcagctacgggagaggggagttaacagctggcaagaaagctgttcctccctgtttggggaaacatgcatgagacagtccttatccatacaaatgacctccctagcacatggagacgggattagaaaatgtctcttctaaaacttttaaatcagaagccctgcagaatgagccacccatcctgagagatggtctgcaaatgtacttaccaatgacacttgaatggccccaaatctcagagagatatcaatccaaaatgtaattactatgagaataacttgactttttaaattattgtgttaatttagaatgtcacaaaaaaggtccaaagggcatgaagctaaaaaaaaatgattagagcttgaaaattttttggtattttccccaggaaagataatactctaatctaaatggacttttagttttagctttgacaggtgaagagtaagaggtcatcatccccacccttacaataggaaaaagctgaacaagctcaaaatcaatgacttttcttggaccatcagagaactgagtttgcagggaaacctgctcctctgaaatctggagagacaagtgcatccagaaagtcacagctgacatctgcttacctggagcagaagccaccggaaccatgagctggtaggaacacttacacagtaattttgaggaaccgttggaggctaagtgtggactaatttgaaagtgagaagctcctgggggtcagtcttaggtgggcacccacattttcatggactttatctccaggaaccccaccaggttctcatggtgatgactgggaaaaccaaagacaaagagaaaaatcttgaaagaaccctaaggaggaaaaagtaggcttcctgcagaggagctagaataaaaattatagtaaattgccaggcatggtggctcacacctgtaatcccaggactttgagaggccgaggtgggcagatcacctgaggtcgggagtttgagaccagcctgaccaacatggagaaaccccgtctctactaaaaatacaaaattagccgggcatggtggcacatgcctgtaatctcagctactcaggaggctgaggaggagaatcgcttgaacctgggaggcagaggttccagtgagccaagattgtgccttgcactccagcctgggcaacaagaatgaaactctgtctcaaattaaaaaatatatatatagtaaacttctcctcagaaagtatgcaagcattggtaggaaaacaggatgactatagttaacaataattgaatgtatatttcaagataactacagaagtgaatttggaatgttcctaacacaaagaaatcataaatgtttacggtgatggatatcccaactaccctgatttgctcattcacattgtacacttacataaaaatataacatgtaccccatgaatacgtacaactagtatgtattcacaaaaattaaaaattagaaaaaaataatttaaaaaagaaagtatgcaagcaaaaagacagtagtataaaatatttaaagtgttagaggggaaaatcaccaacctaggattctatatccagggaaattatccttcaaaaatgaagaagcaccgggcatggtggtgtgtgcctgtagtgttagccctttgggaagctgaggtaggaggatcctttgaggccagaagctcgagaccagtctaggcaacatagcaagacctcatctctacaaaaaaattaaaagattatctgggcatggtactatgcactggtagttccagctacttgggaagctgaggcagaaggattgcttgagcccagaaatttggggctgcagtgtactataatcctacttgtgaatagccacttcactccagcctggacaacatagcaagatcccatttctttaaaaaatgaggaagaaatagatactatcagacaaacaactgaggaatttgtcaccagctgacttcccttacaagaaacgttaaaaaaattttttttcaagcaggacagtgacacatatcagaaacttggatctatatgaagcaaagaagggtgtcagagaaggtgtaaatgaagttcacataaaaatcttatttttcctattcttaattgatctaaaagataactgtttaaagtaacaatagtaatcagtatttaatgattatagcatgtggataaatgacataaatgatagcaatgtcagaaggctggaagggaggactcaggaatactgtttttaaggcacctgcactacacatgaagaagaaatagtgctgtttgaaggtagatttagtttagttttaagaatatactgtaaactctaaagagaactgcttaaatttttttttcagatggagtttcactcttgttgcccaggctggagtgcaatgaagtgatattggctcacagcaaactctgcctcccaggttcaagtgattctcctgcctcagcctcctgagtagctgggattacaggcacacaccaccacacctggctaattttttttttttttttttttttagtagagacagggtttcactatgttggccaggctggtctcaaactcctgacctcaggtgatctacccacctcggcctcccaaagtgctgggattacaggtgtgagctgctgcacctagcctaaaattttttaagaagaattttttactgatattctgagagaagataaaatttttaaaaatcatataaattgctcagagagtgcagaagcagtagcatctgtagatgaataaaaagccgttacaaacatggtcaatattaatccaaatatagtaacaatcactttaaatatgaatggcttaatacactaattaaaggacagagactgtcagagggttatcataaaagaggaagatccaattttatgctgcctaccagaaatatactttaaatataaagactccaaagtttaaaaataaagggatggaaaaagttagacaacacactgatcaaaagaaaactgaagtagcgatgttaataccagacaaagaagacttagaacagggaaaattgttaggagtaaacgggaaacctacctaatgacaaagggaattagttctccaagaaatgtgcatgcacctgattacagagtgtcaaaatacacgaggcaaaaacgaatagaaatgcaaagagaaaaagacaaacccactgtagagatggagaattcaaaaccctctgtcagtaagtgatagatctagcaggaatacaatacataaaggatatagttgacttgaagaacactatcaatcaattcgatctgattggcatttatagaatactctatccaacaataacaaaacacacattcttctcaacctcacctagaatgctcaccaagataagacctcaaaacacatcttaacaaatttaaaagaataggaagacacaacgtatgtaattctaaattaatagtattgttatataacgggcacattctctaaagaatacctactttcctttacttttattatttgctcatgtgaaaggaaaaatgaatcttgggaccccaaaatcactaagctaaagggaaaagtcaggctaggaactgcttagggcaaacttgcctcccattctattcaaagtcatccctctgctcactgagatagatacatatctgattgcttcctttggaaagactaatcagaaactcaaaagaatgcaaacatttttctcttatctacctttgaccaagaagctccgccgcccccccccccacacccccccccccgccctgccacttggagttgtcctgcttttctggaccaaaccagtgtacatcttacatatattgattgatgtctcatatctccctaaaatacataaaccaagctgccccccgaccactttgagcatgctatcaggacctcctgaggctgtgtcatggtgtgtgtccctaactttggcaaaataaacttcctaaattgactgagagctgtctcagatatttggggttcacactaaacaatacgccttctgatgatctcttctgcctagctaatgcctgctcatgctcagcccaaacttaaagattaaaaactttaatacagtataataaaagcataaacaaagttaatcattgaaaagtaatccacagccaggtgcagtggctcacgcctgtaatcccagcattttgggaggctgaggcaggcagattgtttaagcccaggagttcaagcctgggcaatatggaaaacccgtctctaaaaaagatacaaaaattagccaggcatggtggcacacacatgttgtcccggctagtcagagggttcaggcaggaggattgcttgagcctgggaggtcaagactgcagtgagctttaattgagccactgcactctagctcgggtgacagagtgagaccatgtctcaaaaaaacaagaaagaaaagaaaagaaatctatggaaaataatgcaatatttatgacataaaggattaatgcccataatataaaaattgattttataaatcaataaaagagcacattcattcttgacttaactcattctctatacagtagccaaagtagtatctttaaaacccagatctagccatgccatttccctgcttgaagtccttcaatggcttcacattgcccttagaatgaagttcaaaactcttaacatgatccacatgatctggtccttatctatctctagattggtctcccgttacccttctcccatctttctcaggactctagccacactggtcttttctcagctcttcacaccttaaagcctctgcatgtatcgatcgctttgcctggaatcactccaccaccaccaccctcttcgactaatgcccacttttccttcagatctcagcttaaacatcatttctcatgaaagtcttccatcatcaattctggattggttcagatcctctgctatttgctctataaacctgaacaaacagaatcatgtttctgaagcttcagaactccaaacaagactctgaggagtgacccttccaaggaatgtgaggttccaggcaaagcctctagaatcttcttatctataatagtcagggttggtgaggaagctcaggagaaagttaagatgagcgagtctaagctatccgttctgtactttttttgagtatagacaactttgagaacttaataaaatctatgggattcatttcttcttctggagattgcctctcccccagaaaaagtcacagaagcaaaattttgtgtaatgttatcaatgttgcaaagttcccctaacatccatttatccacctcacattaagaaccccaaccattggatgttatgtatttgtcacaggctgaaaacaaacaaacaaacaaacaaaaacaaaaacaaaaaaaatcagcccagtgagaatctcataaaacaaacacattggttccctagctttgttcatttaatcaatgttcattgagtatctacagtatagtgattccagcaataataacaccttataaatgaaatttactttacaatttaaaagaaaataaagacttttcatgtacattgtctcactcttcccccaaacccaataaagtgggcatagattactctacctattttgcagatgagaaaacataagtaatcccagggaacacgagtgatctggttcacacaactcagccaaaaaggagtgaaacccagcagtaaaacgcactcttttaaccctaagcctggctctttccttccatgttgatattgactccaagggcccgtggctggtactaggacttgtccttagtaatctgataataatcccaggggccacagtctcagcctccagttcccatggtggtcagcctcacgctctcatattccatgtgatgatgcaattttgccaatcaaaggtcgcagcagcaggactcccctgacgtataggagaagtagccagagctcttcatcccctgccaggagagcatagtagctcacatttattgagttcttagtacacgctgggcactgttctaggctttttacatgaattaactcattaaatactcagaacaaaaccatgaggcaggtactattataatattatctccattttgtggacacttaggaaagattaatttgcccgagtttgcacgactaataattttcagaatcgagatttgaatcctggagcctgtgctcctaaccaaaccaccatctgcctctcctgagcccattgtccttaacttcttgcggtcatgtgtgctggagagaatgtgatcaaagccctggaccttctccctaggaaaacgcaggtaaacagaattttgcatatttcagggactttggggacacctaagacccatctactgtcgacctcagacttagaagctctatttatctcatacatcctggagagaattgtccagggacaaaaacagaagcgccgccagcgccgcaggacttcgcctctgcaaacgtgtgaggagagctgcgctgcgctgagctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataaggtaaacatctcctgtattcctcaacctaacgttggaagaggcgccagcaccaggagttttctccactcccctgactttgctttgggacttaatgagaaactagcttgtatctgtgagtctggggagccctttctgtctgatcctgtttcctgctcaaaacagagatgcgtgagctcttggggaagggctgccgccagaggctcagatggtcagaagcttcattcattcacttacatcatctgtgttcctttttcaccccctccttctccttgcctatttatgcccctgggtgacccctggcaccttgctctcctaacccttgtaggagactgcatttctccctgttacatctgctagcagtggccaaatacctgaatttctggccaatttgtctgaaattagataaatggtctgcagcagagatgaactgctgttttcaaatcagactccctcatggctccagaaagcttccctccagccatgattccctcacagcccctgtaagcatttgcttatttcaaagcactaacatatccattgcttccttcactcaagtttcttatgcaactcagttttcagtaatgcaggtctccccctaagatagttgttgggaaaaatagtagcctctctcaggataacagttttaattcaaaatccatcactctgaaataatcaaagtgttatatttgccataagaagttattatggctcaccttccttttctctgactttgccatgccttcctgctccagcccctatattttctgctttgataatgccagttcacctgctagtcctttgaaaagctgtacgtgatcctataggtggagttttttaatcaaaacatcactttgaagagtctatgaatgcaagctttgaaataacctaacccaacctcctcctctatcacccagcttatatttgaggaaactaaaatccagagaggaaaaatgacttgtccaagaaagcaagctggtaaatggcagagctgatactaaaagccagaaattactactacacgtgtagtattctttcctctatatccttactaaacttctcatcaaagtgtgcagtccatggaccagcagcattggcattaccttggaacttattacaatagaaagccctgaccctagattggctgaatctgaatctgcattttaacaagatctctaggaataaatatgcacaataaagttttaggtgcatggctctgtgccatgctgcctgtttctgacacaaatgaaagaaaatcagctattgaaggaagcaggtctctagatctgacagtccatgtgtcttctccctccaggtctctgaattcctaggatatagagaaggagaaaaaatgtataacaactatcccagtctagaaattttaaagccatcacagtttgaagtaaactagaagaaattctgtgctatttgatgttgtcaatttagcccagtaaaaactgcatgcaaggccaggcatggtggctcacacctgtaatctcagcactttgggaggccgaggcggtggaccgcttgaggtcaagggttcaagaccagcctggccaacatggtaaaatctgtctctactaaaaatacaaaaattcgctgggcatggtggtgtgcgcctgtgatcccagctactcaggaggctgaggcaggagaattgcttgagcctgggaggcagagactgcagtgaaccgaaatcacaccactgcactccactctagcctgggcaacaaagcaagaccttgtctcaaaaaaaaaaagaaaaaaaaagtttatgcaagcagaggaacataattacaaatcaattacaaaattttcctggcaactagatatgtgggtctctccaagtttataccatcctataaaggtataaatactcattttgaaagctttaagattgggagctcagattgttcaaaatattgatcagatgtggtattttccatttcaattacccacacacgagatgtaggatgtagtccatgaagactgttacttcctttgagtttattgatcaccaaattgagagtgggaacccattccaacaagttccaacatatttaaaggcaagtatctatttactactagtaaaggctcaatgtcatcagcttggctgtgtgagcaccctgagagcaggagccagccttaaaccttctgtggtgcccagcagagtgacatatgtatgtaaggaaagttttccttcttatatagtgctgacaacctcctcctaatactactttatgattgtgcatgatgttttattgtgatccacttaaaactctttttgtaaaggggtagggcatcaacttatttgtattatattaaaaattactatgtagtagagtccaaggagttcccattgattgattagtgtctattgtccatgagaagcagggctcccctccaacattaattgctaggataaattctttttttgaagtggggtctcagtctgtcacccaggctggaatgcagtggtgtgatctcagctcactgcaacctctgcctcccaggcaagtgattctcccacctcagcctccccagtaactggaactgcaggcatgtgccaccatgcctggctaattttttggcagttgttgttttgtagagacagagtttcaccatgttggccaggctggtcttgaactcctggcctcaagagatccacccgctcggcctcccaaagtgctggcattatatgtatgagccaccatgcccagcgtggggaaatgattttttaaatagacttgttattgacacataacaaacaccactttgggaagctgaggcgggcagatctcttgaggtcaggagttcaagaccagcctggccaacatggcgaaactttgtctctactaaaaatacaaaaatcagctaggcgtggtaacacactcctataatctcagctactagggaggctgagacaggagaatcacttgaaccgaggaggtggagactgcagtgagccaagatcacaccactgcactccagcttcagcaacagagcaagactccatctcaaaaaaacaaaaagaaatatgacaaacaccaaaaaatcctgaatcttatgtgtctaccttggtgaattatcacaaagtgaacatacctgtgcaatcactatcaagagaaagaaatagaaccttgtcagcttcccaagaggccccctcccacattccacttgccaaacaccctcccccagagattgtcattatagaggaagaagcatcatcttgtgttttgacagcacagcagatgttatgtagggtagtcctagaaacttgccagagaagagatattgtcgtatgatgaaacgaaactccaggcttggaataagccaaaccttgatgtgactttgagcaacatctgtgagtcttaattttcttagctataaaataggaatgataatacctgccttattatttttgagcaaggatgttagcgaatataatgtaacgcgtatatataaaatctctggaatataggaagcattcaataaaagtggttgtattggctgggcgcagtggctcccagcactttgggaggccaaggaggatgaatcatgaggtcaggagatcgagaccatcctggccaacatggtgaaaccccatttctactaaaaatacaaaaattagccgggggtggtggcatgcacctgcagtcccagctactcaggaggctgaggcaggagaatcgctttaacctgggaggcagaggttgcagtgaaccaagatcacaccactgcacttcagcctggtgacagagtgagactccatccgaaaaaaaaaaaaaagtggttgtattagggcatgcatcttgggctccaaagcagcttcaatgggtgtcacattcagtctcacctaaaatgatgagctttgtgagaagagcagcagcttcatacaagagaatctcagaaacacacacactacctatttcacaggcagaagtccatggaaataaactcacacaacccatctatacaaaaagcgtgacttctatgcaaacatcccagttctgacttcctaagttgagtatcttttttctcttggaggtggtgtatgggacttgatgaaattcatttatatgaaaaacatacgccaaatatcatgataggcattgtgtagctcttgcactttagctggtcccaatagttggaggctgacccaggcaagcccaagtaactcttagaagattcccgtagggtgggctggaagctgggaactgactgaaaacattgagctcatccatcatgtgcctggagtttttaaatagagttgttgttgccacaaatctgaaaatttggtgcagctaaataatttaaaacaaaggagcaacctggctgctcttttccttagagaactctcagttctctcttgccaccagcttcaagagccatccagggcaatggtctggggtaggggttcaggaacagcccacggattgggtccctactgtgccagggtctgaccttgagctcccagaaaatgaaaagattttcatttcattttcacagagagggcaagcttttgccccagataccagtgaattaggacaaaagggcttcagttcaagcacttacttcctaattccctatcaccagggctctaaggaacatccacataccagactagcttccagagggacgaacaattcctaggacaaagtcagtctcagaaagactgggggtggggggcagaaaaacgtgagctgctcatccattcatccagggcttggttcttcttgggtgaaaagggattaccaggtctctgtcttccaaagtatgtccatttcctccgactgctctaacacctcttctgggtgaaaggaaaaggcaagcaggtaatatctgccactctcccccatctcctgcacttattcttcacttccttcttctattacccatcttgtaatttctgtgtccctcaaaagtccgcatgcctcatcgattcattcagcaaacatgcattggacatttccaaagcgtaaagaactaggctggtcattgtcgagaatatagacgcaaatgattcccaccttcactaagcctgtggcctagaaggcatgcacacaaatggctatacttttatataattccagaagtgtcctaagaaagatacgggtagctgcaagggagtgacccaggaagaaaaggtcatgtctgactgaatttgaaatgtcctctctcacttatggcttctgattaaagttaacctccaggcttggcacggtggctcacacctgtaatcccagcactttgggaggctgaggcaggtggatcatgaggtcaggaattcgagaccagcttggccaacatggtgaaactcgtctctactaaaaatacaaaaattagtcagccgtggtggtgcacgcctgaaatcccagctactcaggaggcagaggcaggagaatcgcttgaacccaggaagcagaagttgcagtgagctgagatcacaccattgcactccagcctgggtgacagagtgagactctgtccccccacaaaaaaaattaaaattaaaaaataaaaaataaagttaacatccatgagagacagagttccacacatcagctagctccctccccatgggactgtcacctattaatcctagggaaaggtctggatacaacagtgttctccttccctgccagaaaattgtacaagagaaagacaaataaaacagcaaaagaccatactcgccattctgtgttcctctctcattctctatcccacaggtgcttcttttatttttttttcgatgaaacaatgataatgataatggtatgcaaatttgtcctcaaaagaatccaaattagcagaaaaatccatgccctgtaagtgaagagagttttgttttcaaagcgcactagttccaattctcaaagatttctattgtcagctcaggaacaaacaagaaagccaagaaaagctagctgctccctgtataatatttccactggcttgttttcctctcttgcttgctctgaaggcttacagataaacaaatgaagtgtatattacatcactggcaatctggtgccgtctgggactcctttggctgataggtcggtcctgcccagatcccagagcaggcagctggtgtggggagtggtggtgcctgctagttctcttaggataacctcagcaggaaatgatggtgactcagtccagcgcctcaaagtcgttttccaaactctccaggctttcctctcctaagcatcctttcctttaatttgtggtccctggggccttttgtgagaaaatgtctgagactcacttgtgttgctgccctaatgtttcctcttataagctgttctagggagggacgtccttcagtttcagggcaggaaactccgccttactgggtggaagtaaacagccagaggtgagcaccaggctggagaattgttgaagtgggcatttgaagtggctctaaatttatcccaatacccttcttgcttccttcctcctcttctcaggcaagagaaacagtctgtagagactgcgagtgcgaatggagatcacagctccttgttaactcactcaggcaatgtagttcccagctgggagtggccctggacatcctcctatctcttaaccagaggaggttttctggggccaagagagacagctccaagcaaacagatctggaaaatattaacccctaactgatgacaccaggcctcaccctgctcctaaagggagcaaggccttgagtggtgcagtgaaaataacttgagacgtgcagggctcaagaattctcccagcacatggttcctgaccttgatttctaagtcagctccctcccttctcatttgcttatcagcgccttttcatttgcttattagcaccttctcatttgcttattagcagacagtttctacccatcaacatgaggatgctatttaatcatttgtgcttttgcaaatgcacatgcttttaggtatctgaaaccaagctgtgcttaagttcaaattttctcttacttgctagccttctgcccctggccaccacacacacagacacacagacacacacacacacacacacacacatgcctgcacatgcacacatacgcacccttcctctcatgagctgtgggcagggccagtgatcatccgtttttgttctctgtctccccttagcttttgttatgagccttttaaaagcaaagcaggctgggtgcagtggcttagtcctgtaatcccagcactttgggagtccaaggcaggcagatcacctgaggtcaggagttcaagatcagcctggccagcatgaggaaactctgtctctagtaaaaatacaaaaattagctgggcgtggtggcaggcgcctgtaaccccagctacttgggaggctgaggcaggagaatcacttgaacccggaaggctgaggttgcagtgagccgagatcgcaccactgcactccagcctgggcaacaaagcaagactctgtctcaaaaaaaaaaaaaaaggcaaagtaaacatttctcctcctcttcttcctccctcgcctgtttgaattttgcattcataccctctcccagcaactctgtttattaaaaatcggaactgtcatttattagagcagtacccctaggggagagtcaggaactggtaacaccttccccaagctcacagtgagaagcagtgtaagctttggaagggaataaagtctggtacacagtccagatgaggcagacaccccctttcagcccctggagtctccctcctcgcctcccccatgcctttacccagatccttcctccttctctgggtcccacctcaggtttcatttggttatcaggtaagaaatattaaaaatcatctctgcactataatccaaagggacccagtaagactaataattgttcccaatacattatccaaataagcatatggtttatttctgcagcactttacagtttgcgaaacactttaatatatgccaagacattttatacttaacatatgctttttccagaagatgttactattaaactaattaatgtccatattaataggacagggaaacaaaggccagatggctgggcatggtgcttcatgcctgtaatcccagcactttgagaggctgagatgggcagatcatgaggtcagtagtttgagaccagcctggccaacatggtgaaaccctgtctctactaaaaacacaaaaattagctgggtgtggtggcgggcacctgtaatcccagctactcaggaggctgaggcaggagaattgcttgaacccaggaggcggaggttgcagtgagctgagattgcgacactgcactccagcctgggtgacacagcaaggctctgtctcaaaaaaaaaaaaaaaaagaaagaaagaaagaaaaaactgacttgctcaaggtcatagccagcattgtggaagcctgaatcattacagcagacccttagatagcacttgcatgccatgtaatattctaagcacttagcatctcttaactcacttaatcctacaacaaacctattttaatctcattttacagatgagtaaactgaggcatggagacattaagaaatttgcctatagtcaaatccaagcaaggtagacaggcagagggatagagtcaggagaggacaaggggcttcaccaagagggtcacagatggtcactactttagggcattgacagcagtccattgtgtggccttcagctctgtagagctggttttgctcactcactcaagagtggctccatctctccagtcaggctgatgttaatcagactcacaagacatgtattgccctagatgccaagccacattataatcaggagatttttttgttcgctaagcatgaaatccaggggaaaaaatggaacttggaggattcaaatgtttaatgctatcaggctgacatgagttggtagctggctacactataggcacagcctcaatctacgaccccactggccccttctacccttaggtcctctcccctaccccttgccccacctctgcctccctcagctgtatatatttaactgccttgggccggacagtcattctattctctccaggtctgtatttcctgcaatcctttaagaactccttgcctttgagcttgagaattccctggacttgacctggttatggggagggaaagggaagggatgttccgttcatcatcgccagagttgtcatttcatacttcttcctccatctcactcaaggcctgtgtcagagccttagggacttggatttcaggggcaagaaccatggaagagtagaaaggtgattggggacatttccttataccccaccaccacccctgttcacatgctccccttgaaatctgatatttctgcctgagaatcctgagaatcaattcagcaaatatttactgcgcaccacatgccagtccccaggaacaaaacccactcttcattccccaaggagctgcgtccagcaggctgggtggatcagagggatggcacaggcagagatggctcaggccacatctgactgcagctcagtgtgccacgtggaccttggtgcccatgaaggtcaaagacctctagtcccatatagtgggaagctgagcccttggggaccaggtcaaaagcttgcagctctcgaggctgccaacttctggctcctggctgattgacggatctgaggggttataaagcccaaagtcccaggatggggccccacctctgaaggtcagagggctctgagcccctcaacacagggatcccttcaagcccatgtccaagaaaggaagagactcctgttgcacttctgagaagtgcccagtgcaaagacccctgtccaattgtggcagagtccaacacatagaaactaagctggatcccttccatgaccatctccaaagacatgggctgaaaaacactcaaccaaacccaaaacaccaggatcccagcccttgggatgacagtgtggcacacaaagagaggcttgggaaaacagaggggcacgccacgtgagctctgcaggcatgtcctccaggaccctcactctcctttccctgaaaccaggtctcctccagacagcaggcacatgagaaccagcatagcataggccctgaccatcacctgtcctgaccaccacctgtgctgtctaccacctgtcctgttcaccactggttccatccaccacctgccccatccatcacttgttctgtccaccacctgtcttgtctactgccttccctcttcaccctcatcctgttcactacctgccctgtccaccacctgtcctgaccaccttctgccctgctcactgattttcttagagtaggaggcagctcattagcagagaaagagaactgggctttgagtaccaaagaaccaagctttatccctgtctctgctgttagccagctgtacattctaggtcattccattccaacagcactttccaacttgcagaaaacttgcatataaatcatttcggttgaattccccagcactgtgtgtaaagagaacaggcattattcttgactgcaaaaggggaaatcttgtgatcaggactctcgatttccagtgacaaaacccaactcaaattggcttaagccgaaaagagaactcattggttcctgtaccagagaagcctagggagtgcagctgacatcgagctcagctggtcccagggactctcagtgacttcggcctcactctctgtctctctctctctctcatttttctctctggcttggctccattcacaggcaggcttctccccgtggggccccattattgacagcagccccaggatcacatcctcacagctcccaattccaaacaaagtcctagacccaatactcactggagactgaaattgccacatgcccacccctgaaccaatactatagccagagggtagaacatgatggacggcttaagctcgggtcacatgtccaccccgaaggtggagtcaatcccacccaagccctgtagatcaagagtggaagaaaatgggccgggcgtggtggatcatgcttgtaatcccagcactttgggaggtcaaggcgggtggatcacccgaggtcgggagttcaagaacagcctgaccaacatggggaaaccccttctctgctaaaaatacaaaattagccggttgtggtggtgcatgcctgcaatcccagctactcaggaagctgaggcaggagaatcacttgaacccgggaggcggaggttgcggtgagccgagattgcaccattgcactccagcctgggcaataagagcgaaactccgtctcaaaaaaaaagagtggaagacaatggtttccagggaaaatgggatggtgtcatctggaggctagccatgcaaaaacaacagatgtcccatggtaatccagggcaaggctgagtcccagcattttcaaatctttaatgagaagtgcctgaaaagaaatgaagagaacttgtcacagtcccacctgaactggcctcttggtgcctcacacatagtgtcatttaagactaaataactggatttgggttattaatgactggacttgggaaacaaactgctgtcaccctatgaagcgataggcttattggggctgcagagccagacctccctctatgggtgggagtagaattttctctgaaggaaatagatgatccaactgtggaccatccagggaagaggttgattggagcagggaatgaggattcaggaagctgacggagctcagacaggaatgaggggaagctcttccgcctctcttaaggaccatggttagctgctatggagacgcctgaatttttccattgctgtgtagggcgtgtcagcccagggctacatgaacacagatgagaagtgaggcagaaaagcaccaaacaaggccaactttatgagtatgccacctacaaagtcacataacgccctgcacttagaagggccctgcatttggtttaacactttgcattcgccatctttaaagtcttaataatgtttgtacaaggacccctgtatttttattttatatagccattcttgctgccagataaaaacccctgcaaggtctgagcctggctctgtggggtagttttgagctattccctggggcacctctgccttctgatggcctcacaccacgcctggttttggatgtgcctcgagtaaccagggaagagtcatcttatgctttgggccagatggcaaaggagtgggcagcaccacagtggcattcactgtcgaggggtggttgcgtccccaggacagcatctgcgagggtcacgggcagcaggaagtgtggcctggaaggcagatcagacagtccgaaggtgggtgggtgggcaagtcctcaggggtaagtggctgtgacagaggcaggggaagaagtagacagggatcatgtttgtgatctgagcattgtgctgaaaaaacaataagttcatattggtggctattagtgaataatgagagtcattattttatttatttatttatttattgagacgagtctctctctgtcaccctggactgcagtggcatgcactctgcctcctctgcctcctcactgcaacctctgcctcccaggttcaagtgatcctcctacttcagcctcctgagcagctaggattacagatgtgtgccatgaagccctgttaatttttttttttttttttagtaaagatggtattggccaggctggtcatgaactccagacctcaagtgatccacctgcctcagtctcccaaagtgctgggattataggcgtgagccaccacacccagccaagagagccattattattaatatatttaattgcaaaatttgaaaaatgaaaaacaaagaaaaaatttcctgtgatgccagtgtttcaaaatacatatcttaaaaataaaaatggactgcgcacggtggcttacgcctataatcccagcactttcggaggccgaggtagctggatcacttgaggtcaggagtttgagaacagcctgaccaacatgacgaaaccctgtctctactaaaaatacaaaaaagttagtcgcgcatggtggcgggtccctgtaaccccaactactcaggaggctgaggcaggagaatcacttgaacctgggaggcagaggttgcagtgagccaagattgtgccactgcactcgagcctgggtgacagagcaaggttctgccttagaaaaaaagaagatgaaattgccatgtaaaaatacatgcatgtgtttatttatacatatgtgtgagatagatagatagatagatagatagatagatagatagatagatagatccatcataggaattttgttatacacatttttaccttcattctttttaatcactacatagaattccattgtatagataagtgaaaattcatggtttattctgaaattttgaaactcatagaaaggtacaaaaactagaagaacaaaaagaaaatgacacatgtacctaccatctatatttactaaatgctaacattttgccttaaaaaaaaaaaaaaagaaggctcctataggtagctgggatccactttgcaagatagccatgggatagaaggttaattgggttactttgtttttgttttgatatggagtcttgctctgtcacccaggctagagtgcagtggcgcgatctcggctcactgcaacctctgccttctgggttcaagcgattctcccacctcagcctcccaagtagctgggattacaagtgtgcaccatcacacccagctaattttttgtgtgtttttagtagagacagggtttcaccatgttgaccaggctggtctcgatctcatgacctcaagtgatctgcctgccttggcctcccaaagttctgagattacaggcgtgaaccactgctccaagccctagtttggttactttgaaatcacagcctgatgggtctgcggcacttttagttacactccatttcgtagaagagaaaagagatctgagagacattcagtggttgttcaagggcactcagcagggaataaaagagaaaccccaatccaagcttcaactccagaccctaactcttctccttatccctccctagattcccaaggtccttaggaaagggaaggcttggactggaagctcccccaaacccctttatcactgacctccagaaatgctagtgaagcccaggtgacaatctcagcctggcccaggataaacaccaaagcaaaatcaatgccagtgggagatattcattcacaaagtggattcaagaccctgcgtgcagagctgctcagatgaagcaggcccaaatgcagttagtcaccgttaattgggtctcaggagtggaggagcaaacaacagcatcccctggggatttgcctccatcaacccaagtgcagggtaagaagcccaggaaagcaagccaagctttgcaagcaccagcactgcccctgggcagactctccttcactctatctccacgttctctcccatttgccctcatatcttgttatattttttttttcttgagatagagtctcactctgtcacccaggctggagtgcagtagtgccatttcggcttaccgtaacctctgcttccaggttcaagcaattctcctacctcagcatcccaggtagctggggttacaggcacacgccaccatgcctggctaattttttgtatttttagtacagacggggtttcaccatgttggccaggctggtgtcaaactcctgagctcaggcaacccacacgcctcagcctccaaaagtgctgggattacagacgtgagccaccaagcccggcctattattattatttttgagatggagtctcgctctgttgcccaggctggagtacagtggcaccatctcagctcactgcaacctctacctcctgggttcgagtgattctcctgcctcagcctcccgagtagctgggattacaggcgtacaccactacacctagctagtttttgtattttttttagtagatacgaggttttgccatgttagccaggctggtctctaactcctgacctcaaatgatccacccatctagccctcccaaagtgctgggattacaggcatgagccatacaaccagcctcttctagtattttaagctgacttactgtacctacatctccactggttctttcccttgccacctgccagacagctggatgttacagtgcaaggatgcaaggtctctgggtcgcagtccttctttgcttattattaattttgcagaggctgtgtgaagtttgaaataagtgcaccgtctgaatttcacaactctttccactgaactgagggaaggcaccgggcagtatagctgagatcagggcctgtgacctgttgcttctttgtcgtggaaaccctctgcgtcattgatagagggcagcattctgcatgtaaatgccaacaagtgccagtgctctgctctgctcatagcagatttctactacacaagggtgcagaatgtccctcctgtatttctgaccttgggggacagtctttcccctcccttaattctgagcccctcctcagaggtaccttcagaaaaacaaatgagtcagtcaccttttctttttatttattcagtttattttatttatttattttatttttatttatttatttatttatttatttgagatggagtcttgctctatctcccaggctggagtgcaatggcacgatcttggctcactgcaacctccatctcccaggttcaagcaattctcctttctcggcctcccaagtagctgggattacaggggcccgccaccacacccagctaatttttgtatttttaatagagatggggtttcaccatgttggccaagctggtctcaaactcctgacctcaggtgatccacctgcctcggcctcccaaagtgctgggattacaggcgtgagccaccacacccagccaagtcaccctttcttgatgcaagagttgcagaccctcaggacagagccatgtgaggatatggtcacagtggactactttggggaaggggcttgtgctggggcagggggaatctgattgcttcaagggtccctttcacaactactggagagctccacagctctcattagtgacaaccttcatcagcctccaaacaaagagggtcactagaggccctcaggggaagcctcactacaccagcggagatgtgatggagcgggtccatgcctggagaacagtgtgaaccggatccatggctgccaattctcagtccatacctaagtaccagcccctgacaagtaccaactgatgtgtaggaaacgatacacacacatcagtagatgttggcataaagttaccaactgtcctttcttaggaaatactgtctattatcctgagacttggggtgctcaaagctcctttcttttatgaaattatggtgacaatggattgttgaatagaaactttgttaagcaacccctcacttaaccaacttattaggtcaaccaatacccttcagtctcttactggagcacactgactaagcctgaggcacagagtgctcacagctggcaggctcttctctgctctcacagttgtggtacctggttaacaagaatgcatttgggcccatacttgcttatgctggtcatacgtgttaactagaatgatgtacttgaatcaattcacctgtaaacaaaggaattggccgggcgtggtggctcacgtctgtaatcccagcactttgggaggccaaggcagggggattacctgaggtcaggagttcgagaccagcctggccaacatggtgaaaccctgtctctactaaaaaatacaaaaaaattagccaggcatggtggcaggtgcctgtaatcccagctacttgggaggctgaggcaggagaattgcttgaacctgggaggctgaggttgcagtgagctgagatcacgccacggcactccagcctgggtgacagagaaagactgcacctcaaaaaaaaaaaaaagaaaagaaaagaaaaagaaaatacaaaggaatttaaacagaaagactattgaccaataaaataagagtgtaaaaaaaaagagaacggttatctctacaaaaactaaactgctttggaaagacactataaaagcctgtcactttttaaaatgctatcaaattaggaatgaatgagagaactgtaaaatatcggaaagaaatgcataaaaatgaagaaagattttgcaatcaggtggcttcataagtttctagaatttcttgcttcatgttaaagaaactggaactgaaaccccaggatcatgtgtgtgtggtttgtgcttcaggaaaggcaatgggccccacttttcagcagacttgtaagcaaagcaaaggctttaggtctacatcaaaatacttgctaataactacacatttagatattttaagtcaaaataaaacatgtagaggaaaaatagccttggcgcagtggctcaaacccgtaatctcagcactttggaaggctgaggcagatggattacttgaagtcagttcaagaccagcctggccaacatggtgaaaccctgtctctactaaaaatacaaaattaaccaggtgtgggcgagtgtggtagctgacacctgtaatcccagcactttgggaggtcgaggtgggcagatcacctgaggtcagaagttcaagaccagcctgaccaacatggtgaagccccgtttctactaaaaatacaaaaattagccaggcatggtggcacatgcctgtaatcccagctacttgggaggccgaggcaagagaatcgcttgaagtcgggaggcagaggttgtggtgagccaagattgcgccactgcactccagcccgggtgacagagcaagactctgtctggaaaaaaaaagaaaaaagaaagaaagaaaagaaaaaatacagtatatctcttttatgagttccgggtttaacaaactttttcaatgaactgaccaattaccaattcctgtgaaattgaataagaatttacctacttggttcagacatatttgactttggcaaagaaaactgaaaagctaaaaaaaatgtgcctacttggtagaataaaaggctgatcactgtatctgtccttgccaatctaaaaaatttattggtacatgaaatcaaccgattccagcagtctcccctttccaaggctaagcagctttgagctctatttttcaagatgtcaagcaaaggtagcctttcacctcacttgagtgcaaatttatcttactcatggattttggaggttgccaactcagtagtttttttttctccctcaactactctcaaacagtactatcttctgaaagccaatgatatgcacatagttctcaaaaggaggctgtccaaagcttacaggcttatcaagtggaatcttttttgacatgaggcctcactctgtccctgaggctggtgtgcagtggtaccatctcggctcactgcagcctcaacttcctacgttcaagcgatcctaccccctcagcctctggagtagctgggtctacagtcgtgcacaaccacacccagctgattttttatttttggtggagatatcctttttgtaggcctccctatgttgctcaggctggtctcaaactcctgggctcaatcgatcacccaccttggcttcccaaagtgctgagattagaggcatgaaccacgatgcctggcctggaatctttaaatattaataattcaaaaaccaagaagggaagccccagcaactttagatggctataaataattaggcactcaatcaggattgagtgcttagaaatcttggagtttgttttaacacaatgtgctttcctggaaatcatataacaagatagtaaatgctaccctcactcagacctgaggaaccatatttaagatggttcctcttgcaataaacgtgctggccagccacccaaattctgccttagcaaagtcatgatggggtgcggggatacggctgagatgacacccagatacaaatctatagacattatgaaacaatttcctttcctgcctcttgcgtatatctgcctccctcctctcgccccagctacttctctagcactctaaactctagctcaggcttgagcaaaccgggctggattagcagctgactcctacagtcatagcactgcacagagagaacccagacacttcctatcaggaccacaaggcagagatctgctctgtccagctctggaattgactggactggctcatgactgtcaacctatttctgagaacataaaaaggtccctttcagactgccaccaattcagagggctagaattttagataaaaacagtatatccagtaatctgttctctcttgtagacacttcctcgtttttttgagacagggtctcgttctgtcaccgaagctggagtgcagtggcatgatcacagctcactgctgcctagaactccagggctcaactgatcctcctgcctcagcctcccaagtagctgggaccacagacgcctggctaatttttttaatttttttgtagagatagcaatcctcaagcaatcctcctacctcagcctctggagtagctgggactgcaggcgtgcgccaccacacccagctaattaattaattattgtaggtctccctgtgttgcccaggctgctctcgaactcctgggctcaatcaatcacctgccttggcctcccaaagtgctgggattagagttgtaagccaccatgcctagcccagaatcgttaagaattaataattcaaaaaccaagggagggaaaccccagtaaccttagatgggtttatcacgttgcccaggcttgtctcaaacacctggactcaagtgatcctcctggctaagccttccaaagcactgggattacaaacgtgagccaccatgcccggcctgtagacaccttttttcaaagtttgactaaggcaaccaaaagggatcagaatggatcggtcttcccatgctgtttcactgctcttcagcagcccatgtccaccatccagatgaaggtagaagcagcccaattcctccagccaagccaaattgagctaaattctagtcttccctgtgcgtctagcttaatgtcagaagtttcatggcaataatcttcactgggatctatgattttatattaccagaaaagatgaatccgtttctatccaacataagcatatacttatacattctgggtagtgctggctgcttgaaataaactctgaaataaatccactttatgcacaatagttgaaatggcacagttacgctctgatctaaggccttatgttatgccatttttttttttttttttgagacggagtcttgctctgtcacccaggctggagtgcagtggcgcgatctcagctcactgcaagctccgccttctgggttcatgccattctcctacctcggcctcccaagtagctaggactacaggcacccgccaccacacccagttaatttttttgtatttttagtagagacggggtttcaccatgttagccaggatggtctcgatctcctgaccttgtgatccgcccacctcggcctcccaaagtgctgggattacaggcatgagccaccgcacccggccatgttatgacttttattcttataccttgactcattctaatttggctctgctttgaacttttccattttaagatctctctgtgggcgcttcttgctctgtaaatttaaaacagtctgtgtcaaaaacagtctcactctgacctgaccagcttagatgactagctcaagaatagtcaagcttgcttgggctccatgaagtcccccagagcggaaaagcccttgaaattctagggaatgatctttgaggtcatgggagcaggatctctccaccaaggtcaccaatgccagatgcccttggggtgtccatagctgtgagaagtcaggcaaaccccaggacacattgatatggactgctaaacatgcctacagcctcctacctgctgggtcaccggcctgtggtgctcagggatagctcgtcatctcttcccaagccatgatgcctttccctgacactttatccccagcccctccctacaatccccccatccaacaaaaatcaacctagatgaagtgatagacctttgtcctccagccagaggacatcgtagcccctcatctctcctcaattttcaggagaggaaaaaggagtctgtccacgtcatgcttctgggcagtcaatcctgaaattccttaggttgtttggcccaggactgccctgccagaatagtgaacaccgctgcctgtgctctgagagatgccttctactccaaatacactgcttattcattgagtcaaccaataaacatttgagaacccatcatgtgccagacagtaactaggcacgggggatatgggagtgaatgagacaaagtccccacttaaggcaccacacagcctagtggagatggggaaaatgacaaacacagaccccactacataagtcatttcaccaaaggaaataaagcggagcaacaagacagagagaaattggaggtgggctgcaggggccactgccccctaagtggccaaggaaggcctcttctaagaggtaacatttaagctgaaatgtgatgataaaaaggagctaactattcaccagtctgcgggaagagcattctggaaaggaggaatagcaaatgccaaggccctaagaagggagcaagccttatcttgttagaaggacagaagaaaagctggtgtgcatggagcagagcctttgagagggagggtggatggagttgggggtgaaggggcagccagcagcccatggatcccctgagaacttgcaggctgggagagaaaccatcagaaggctataagcagggagtaatcaggtctgtgcttggaaaagatcactctggttgctgggacgagaatggactccatggcagagaatgaaagaggaagaccaggcagggaatggttgcttggactagcaatcattgtgggcttggtaaccacagagatgatgagacgtggtggggttcagggtactttctggaaggaaggctgtcagattgctaaaataaagataataactctgtctgggtgtggtggctcacacctataatcccagcactttgggaggtcgagataggcagatcacttgaggccaggagttcgagaccagcctggccaacaaggtaaaatcccatctctactaaaaacatgaaaattagccaggcatggtggcaggcacctgtagtttcagctacttgggagactgaggcaagagaattgcttgaacccgggaatcagaggttgcagtgagccgagatctcaccactgcactccagcctggggaacagagtgagactctttctcaaaaaaaaaaaagatagtccagcatctgtaaatgagcatgatccctgtgtgagcagcagtgtatgtgtatacacacacacacacatgcagacacatgcacatacacactatcctccttatacaaacagtgcagactccaggctctggagtcaaatgtgttcaaattccaactcatctgcttacttgccattaaacttggttcaagtcactgaacctctccatccctagggttctctgtctgtaaaaaggggacagtaatagaagtgcctcatggttgtcatgaggattaaattagttactacatgggaagcatctaaggaagggcaactgccacataccgtatgagtttcctgttgctgctgtaacaaattagcaccaatttcgtggctcattaaaaacaacacaaatttattctcctgcaattctggaggccaggagctcaagatcagtttcaatgggctcaagtcaaggcgtgggcagggctggtttcttttggaggctccaggcaggggaatccattcctttccctttctggcatctgaaggctgcggcattcatggcccctgctcacgtcacacccacgtccacttccatcatcactttgtctctacctctttgaccttctggcctctttcttatgaggacccttgtggtgatattttgggcccacctgaatcagcaagaataacctctctatctcaaagtccttaacttacatacatctgcactgtccctttctgccacagaaggtaacagtcacaggttctgaggattaggacacagatatctttgggggccattattcagcccataacatgtggtaggcaataaataaaggttcattgtattacgataatggta

SEQ ID NO: 124 - DNA, 7283 bp, Homo sapiens
  source 1..7283: mol_type = genomic DNA
ttctctactatattttgtgccctataatgaatgagttaatgaaaaacccactccttggaattatatcatatcttgctttcagttggatcataaatatattttcccaggtgaagtatacttatgatataacaaactttagggttgaagtacatcccctaaaattcctgtgttgaagtcttaaaccccagtacccaagaatgaaactgtttttgaagacagcatctttatagaggtgatcaagttaccttgaggtcaatatgactggtgtctttataaaaagaggaagttggtagcaggtgcctatatacaaggagagtgctgtgtgaatacaatgatgccacctaccagcaaggagcaggcctggagcagcccctccctcacagcctcctaaggaaacaatcctgccgacaccttgatcttagacttcctgcctccagggctgtcagagagatttctattgctcaagccacctggaccctggtactttgttagggcagccctagcaaacaaatataccacattattaacacatttaaaaagtataaggccaggtgtggtggctcacgcctgtaatcccagcactttggaagactgaggcgggcggatcacctgagatcaggagttcaagaccagcctggccaacatggtgaaatcctgtctctactaaaaaatacaaaaattagccaagcgtaggggcgggtgcctgtagtcccagctactcaggaggctgaggcaggagaactgcttgtactcaggaggtggaggttgcagtgagctgagatggcgccactgcactccagcctgggagacagagcgagactccatctcaaaacaaataaataaataaaaataaaaattataaatgccaaccctccatcttcatagaatcagccgccattgctaggcatctggcttccaactagtggctactgaaataataaactccacattttaatacataaatcttcatctgtatcctcattatttccaggattactgtttccccaggaggataaactggaccccaactcgtattgcccagtgggttccccgaaatgtaagagtgctgccagggatttaaatctccaccaggctgggaactgaaaaatggttttctgactgggcacagtggttcacacttgtaattccaacaatttgggaggctgacgtgggaggattgctcaagcccaggagctcaaaaccagcctgggcagggccgggcacggtggctcacgcctgtaatcccagcactttgggaggccaaggcgggtggatcacctgaggtcgggagttcgacaccagcctgaccaacatggagaaaccccgtgtctactaaaaatacaaaattagacaggcatggtggtgcatgcctgtaatcccagctactcgggaggctgaagcatgagaatcgcttgaactcaggtggtggaggttgcagtgagccgagatcgtgccattgcactccagcctggaaacaagagtgaaactccatctcaaaaaacaaaaacaaacaaacaaaccagcctgggcaacataacaagatcccacttctaaaaaattagctgggggtggtggtgtgtgcctgtaatcccagctactcgggaggctaaggtggatcacttgagcccaggacgtcgaggctgcattgagccatgattgcaccactgcaccccaccctgggtgacagattatcctatatttattagacatttgtgttcacttgtgaattatctgttggtgtgctttgacaatttttctgctggcgtggtggaattcttattatttttaatacagagattaagctgagatggaattttcattgatatgtaagaactctttatatagtaaagatcactacatacacaccatagacacacaccatagatacatacatcacgcaccacataccataggcacacaccataggcacactgcataaacatcacagacacacacaccacacaccacagacacacacactgcacacaccatagacacatcacacacacaaccccataggcacacaccacactctacacacacaccatagacacacacatccaccacagatgcacacataccatgacacacccaggcacacacactatgacacacacacaccatgacacacaaacacacaccatgacacacaccatgacacacacaaacacataccatgacacacatgtatttctcctaatttgttgtttgccttttatttatattacctattttgacatacggaggtttaaaacttttatgtaaattgatggtaactttttcttagtaacttcctttattacttttatacttaatataatcctttccaagctaaagatcgttaaacattggtctatattttcttctatgttcaatgaactacttttaatgtttcaaaagcctaattcaaagcatatatttacctgaaagggactcacatgttaactaaagtatcgagcagttcattgagtgtttatgttgtttttattgctaggccctgtttttattgcttactcagttatctgacaaaaacactgaaatctatgataaattaataaagctgggacgtttatttttatttatttatttatttagagacagagtttctctcttgttgcccaggctagtggagtgcagtggtgctatcttggctcactgcaacctcttcctgccaggttcaagtgattctcctgcctcagactcccgagtagctgggattacaggtgcccaccaccacgcctggctaatttttgtatttttttagtagacaccagagttcaccacgttggccaggctggtctcgaactcctgccctcaggtgatccacctgccttggcctccaaaagtgctgggattacaggcgtgagccaccacgtccggccctgtttttatttttttgaggtggagtctcacactgtcgcccaggctggagtgaaatggcacaatcttggctcactgcaacctccgcctcccaggttcaagcaattctcctgcctcagcctcccatgtagctaggattacaggcacctgccattacacctggctaatttttgtatttttagtagagacggttttgccatgttggccaggctggtgtcaaactcctgacctcaggtgatccgcccgcctcaacctcccaaagtgctgggattacaggcgtgagccaccatgactggccggggacatttattatataaaactttatggacaattttaagaggtgccttggccgtgacccggaggcctatgtggtttggcccacctcatggtccacaccctctcagctgccgcaacgctgcacatgtgacaaacacgtgtgtgagatccacggttctcatactatcacacgctctggtgagagtaatggctcatcacaggcaagatttaccgcgaaatgggacaggcggggtcattttaacttcctccccaggccaccccctccaccctgctgaaagcacctgcaataaaatacgttttcagaaattcaccagatgtcccttccaaagatcaagcccagctgctcccctcccctttatgggcaggcggccctccaggggtattgcgaacgggctccagcgacagctgctcggaggctaccatgggacagtacccgggcagccacagccctccatgccctccttccgccccgcagtcccagcatgaagccacagttccccatgagcccagggcaagctcgtcagagacccttccctgcggaggcccacagcccctgcggccacttcttccccgaatctcaatcctgcttcgtgtggccactgctgaaagagacgctcagtgccacttagagcgcacagcccactggtccaggctgtgcacacccagggacccttccaggcattcctcacctcggtgcaggccaggagcgagaactgctgccgggcccccccccaccggctcagggcgtggctggggtggccctgctcctcggtggcccgcctggccccgctgtgggcttccctcccaccaccccggccacagtcacagcgggttgtgtcaggccgccctcatctcccacctcccaggcccagctggcgcctccagccctggtgtgaatttccattcagggtccaaaatccaccttggcagcgccctcattctgcagctccacggagccctccagccagagaagagaaatctgagtttaacccgatcctgtcagaagagcgggaggaaagagctccggcggacagggctcccaggcccctccaggacgaggttggaggaccaagcgcagaaggtaaggacgcagccctcggcgagtgcgggcggggcccaaatccctcgccggccggctaagcagaagcggcttttggctttccgcgacaaagcgcagctccgggccagacggtcctgcccggccctacccgcagccccggccccaaccagaggccccacttcagcccaccaggcaggactgcagcggggcacgccccacggaccccagccccttggagatcccaaaccccatgcctgctgctcccaccccggaggagtcagaggccgagaagcacacacaccatagaccccacaccacgcacaccatagacacacataccacacaccacacaccataccacacacaacacacaccacagacacacacaccatacaccatagacacacataccacacacaccatagacacacacactacacatcatagacacacacaccacacacaccatagacacacacaccacacaccatagacacacaccacacgcaccatagacaaaccacgcacaccatgcacacaccacacaccatatacacacacaccacacacgacacaccataggcacacacaccacacaccacacaccatagacacacacaccacacaccataagcacacacaccacacacaccatagacatacacaccatagacacacagacacacatgccatagacacacatgccacacacgacacaccatagtcacaccacacatacaccagacaccaagacacacacactacatacacaccatagacacacatacctaccacacactacaaaccataggcacatacaccatagacacacgcactacatacacaccgtagacacacaccacagatacatacatcacacaccacataccataggcacactgcataaacatcacacacacaccacacaccatagacacacacaccacacacaccatagacacaccacacacacaaccccgtaggcacacaccacactctacacacacaccatagacacacacacacaccacagatgcacacataccatgacacaaccaggcacacacactatgacacacacacacataccatgacacacacacaccatatacacacaaacaccacagacacacacacaccataggcacacacaaacacaccaggacacacacaccatagacacacacataccatgacacacacgcaccccatgacacacaccacacacagccaccctctgctctaccagctttgcctctgttctccgacagcgccagtgttgacacgccagaggctgcctgggccccactccttcccagctgtctccaggattagggaagccccaggcggatccggggccgcaggagcctccctacccagcccccatgctggtctgtcttgggtccataaacacaagtcagccacctgtcaccgggcggcaggaagtgcaggctctgtgagctggaggagggggcgcctaggctctgagggctgaataaggggcctggcaaatgcccccggagagccctggagagttttgcagcagtcctggcacctgggcttcggggcccgcctgctgggagcagccgcctgctgggagcacctccttgctggaagcacccccctgccaggagccccccacccccacccaggagcaccctcctgctagagtgccagggagacactgctgcctaatggccaggagcttgcccagggcagtgacttctggtccacttctgtcccttggttgtgtccctaagacccagggaccctggaaggttcacctgtcggtgtcacacggttccttcttcacacagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaataatggaggattatttaatactaaaaagaaaggggcggccgggcatggtggctcacgccagtaatcctagcacttagggaggccaaggcgggtggatcacctgaggtcaagagttcacgaccagcctggtcaatatggcaaaaccccatcgctaatttaaaaatacaaaaattagccaggcatggtggcgcacgcctgtaatcccagctactcaggaggctgaggcacgagaatcacttgaacccgggaggcagaggtggcagtgagccaagattgtgccactgcactccagcctgggtgacagagggagactctctctccaaaacaaacaaacatcatcttctgggggaggggggaatctattagtttaaaataaaaagaggcttgagatcaggaagcttgcatccaaagaggtgtggaggaggcgtggacgagggtggagttgtgtggaccaatgccgagaacaggcaggcactagaggcaggctgaacagagcagagtcaaagacaacgtttggttcctggactgagaacccagctgccggcagcccaagttgtctgatgggagagtttcctaatgtccttgaatctgcaagatgcaagactttgaatggcccttgcccacagcagtgtggagcagttgatgcccatgaccttagggacctggagtcctgcggggtttgaggggggcaaagaaaaccattcgtcctgggaggcaaggaagctggatgtcaggaaggctgccccagtatggaactcagagcaagggggacatccaggttcccttctgcgggcctggggctcttcctaggggccagatgccttctcatcagtacacgaacagaggcgggggcagccagcagaactcctaagacacaaaatgagtgaacactggaaagggagctgagacaggcctgcagcaaagaacagacacca

SEQ ID NO: 125 - DNA, 3452 bp, Homo sapiens
  source 1..3452: mol_type = genomic DNA
ttctctactatattttgtgccctataatgaatgagttaatgaaaaacccactccttggaattatatcatatcttgctttcagttggatcataaatatattttcccaggtgaagtatacttatgatataacaaactttagggttgaagtacatcccctaaaattcctgtgttgaagtcttaaaccccagtacccaagaatgaaactgtttttgaagacagcatctttatagaggtgatcaagttaccttgaggtcaatatgactggtgtctttataaaaagaggaagttggtagcaggtgcctatatacaaggagagtgctgtgtgaatacaatgatgccacctaccagcaaggagcaggcctggagcagcccctccctcacagcctcctaaggaaacaatcctgccgacaccttgatcttagacttcctgcctccagggctgtcagagagatttctattgctcaagccacctggaccctggtactttgttagggcagccctagcaaacaaatataccacattattaacacatttaaaaagtataaggccaggtgtggtggctcacgcctgtaatcccagcactttggaagactgaggcgggcggatcacctgagatcaggagttcaagaccagcctggccaacatggtgaaatcctgtctctactaaaaaatacaaaaattagccaagcgtaggggcgggtgcctgtagtcccagctactcaggaggctgaggcaggagaactgcttgtactcaggaggtggaggttgcagtgagctgagatggcgccactgcactccagcctgggagacagagcgagactccatctcaaaacaaataaataaataaaaataaaaattataaatgccaaccctccatcttcatagaatcagccgccattgctaggcatctggcttccaactagtggctactgaaataataaactccacattttaatacataaatcttcatctgtatcctcattatttccaggattactgtttccccaggaggataaactggaccccaactcgtattgcccagtgggttccccgaaatgtaagagtgctgccagggatttaaatctccaccaggctgggaactgaaaaatggttttctgactgggcacagtggttcacacttgtaattccaacaatttgggaggctgacgtgggaggattgctcaagcccaggagctcaaaaccagcctgggcagggccgggcacggtggctcacgcctgtaatcccagcactttgggaggccaaggcgggtggatcacctgaggtcgggagttcgacaccagcctgaccaacatggagaaaccccgtgtctactaaaaatacaaaattagacaggcatggtggtgcatgcctgtaatcccagctactcgggaggctgaagcatgagaatcgcttgaactcaggtggtggaggttgcagtgagccgagatcgtgccattgcactccagcctggaaacaagagtgaaactccatctcaaaaaacaaaaacaaacaaacaaaccagcctgggcaacataacaagatcccacttctaaaaaattagctgggggtggtggtgtgtgcctgtaatcccagctactcgggaggctaaggtggatcacttgagcccaggacgtcgaggctgcattgagccatgattgcaccactgcaccccaccctgggtgacagattatcctatatttattagacatttgtgttcacttgtgaattatctgttggtgtgctttgacaatttttctgctggcgtggtggaattcttattatttttaatacagagattaagctgagatggaattttcattgatatgtaagaactctttatatagtaaagatcactacatacacaccatagacacacaccatagatacatacatcacgcaccacataccataggcacacaccataggcacactgcataaacatcacagacacacacaccacacaccacagacacacacactgcacacaccatagacacatcacacacacaaccccataggcacacaccacactctacacacacaccatagacacacacatccaccacagatgcacacataccatgacacacccaggcacacacactatgacacacacacaccatgacacacaaacacacaccatgacacacaccatgacacacacaaacacataccatgacacacatgtatttctcctaatttgttgtttgccttttatttatattacctattttgacatacggaggtttaaaacttttatgtaaattgatggtaactttttcttagtaacttcctttattacttttatacttaatataatcctttccaagctaaagatcgttaaacattggtctatattttcttctatgttcaatgaactacttttaatgtttcaaaagcctaattcaaagcatatatttacctgaaagggactcacatgttaactaaagtatcgagcagttcattgagtgtttatgttgtttttattgctaggccctgtttttattgcttactcagttatctgacaaaaacactgaaatctatgataaattaataaagctgggacgtttatttttatttatttatttatttagagacagagtttctctcttgttgcccaggctagtggagtgcagtggtgctatcttggctcactgcaacctcttcctgccaggttcaagtgattctcctgcctcagactcccgagtagctgggattacaggtgcccaccaccacgcctggctaatttttgtatttttttagtagacaccagagttcaccacgttggccaggctggtctcgaactcctgccctcaggtgatccacctgccttggcctccaaaagtgctgggattacaggcgtgagccaccacgtccggccctgtttttatttttttgaggtggagtctcacactgtcgcccaggctggagtgaaatggcacaatcttggctcactgcaacctccgcctcccaggttcaagcaattctcctgcctcagcctcccatgtagctaggattacaggcacctgccattacacctggctaatttttgtatttttagtagagacggttttgccatgttggccaggctggtgtcaaactcctgacctcaggtgatccgcccgcctcaacctcccaaagtgctgggattacaggcgtgagccaccatgactggccggggacatttattatataaaactttatggacaattttaagaggtgccttggccgtgacccggaggcctatgtggtttggcccacctcatggtccacaccctctcagctgccgcaacgctgcacatgtgacaaacacgtgtgtgagatccacggttctcatactatcacacgctctggtgagagtaatggctcatcacaggcaagatttaccgcgaaatgggacaggcggggtcattttaacttcctccccaggccaccccctccaccctgctga

SEQ ID NO: 126 - DNA, 3832 bp, Homo sapiens
  source 1..3832: mol_type = genomic DNA
aaagcacctgcaataaaatacgttttcagaaattcaccagatgtcccttccaaagatcaagcccagctgctcccctcccctttatgggcaggcggccctccaggggtattgcgaacgggctccagcgacagctgctcggaggctaccatgggacagtacccgggcagccacagccctccatgccctccttccgccccgcagtcccagcatgaagccacagttccccatgagcccagggcaagctcgtcagagacccttccctgcggaggcccacagcccctgcggccacttcttccccgaatctcaatcctgcttcgtgtggccactgctgaaagagacgctcagtgccacttagagcgcacagcccactggtccaggctgtgcacacccagggacccttccaggcattcctcacctcggtgcaggccaggagcgagaactgctgccgggcccccccccaccggctcagggcgtggctggggtggccctgctcctcggtggcccgcctggccccgctgtgggcttccctcccaccaccccggccacagtcacagcgggttgtgtcaggccgccctcatctcccacctcccaggcccagctggcgcctccagccctggtgtgaatttccattcagggtccaaaatccaccttggcagcgccctcattctgcagctccacggagccctccagccagagaagagaaatctgagtttaacccgatcctgtcagaagagcgggaggaaagagctccggcggacagggctcccaggcccctccaggacgaggttggaggaccaagcgcagaaggtaaggacgcagccctcggcgagtgcgggcggggcccaaatccctcgccggccggctaagcagaagcggcttttggctttccgcgacaaagcgcagctccgggccagacggtcctgcccggccctacccgcagccccggccccaaccagaggccccacttcagcccaccaggcaggactgcagcggggcacgccccacggaccccagccccttggagatcccaaaccccatgcctgctgctcccaccccggaggagtcagaggccgagaagcacacacaccatagaccccacaccacgcacaccatagacacacataccacacaccacacaccataccacacacaacacacaccacagacacacacaccatacaccatagacacacataccacacacaccatagacacacacactacacatcatagacacacacaccacacacaccatagacacacacaccacacaccatagacacacaccacacgcaccatagacaaaccacgcacaccatgcacacaccacacaccatatacacacacaccacacacgacacaccataggcacacacaccacacaccacacaccatagacacacacaccacacaccataagcacacacaccacacacaccatagacatacacaccatagacacacagacacacatgccatagacacacatgccacacacgacacaccatagtcacaccacacatacaccagacaccaagacacacacactacatacacaccatagacacacatacctaccacacactacaaaccataggcacatacaccatagacacacgcactacatacacaccgtagacacacaccacagatacatacatcacacaccacataccataggcacactgcataaacatcacacacacaccacacaccatagacacacacaccacacacaccatagacacaccacacacacaaccccgtaggcacacaccacactctacacacacaccatagacacacacacacaccacagatgcacacataccatgacacaaccaggcacacacactatgacacacacacacataccatgacacacacacaccatatacacacaaacaccacagacacacacacaccataggcacacacaaacacaccaggacacacacaccatagacacacacataccatgacacacacgcaccccatgacacacaccacacacagccaccctctgctctaccagctttgcctctgttctccgacagcgccagtgttgacacgccagaggctgcctgggccccactccttcccagctgtctccaggattagggaagccccaggcggatccggggccgcaggagcctccctacccagcccccatgctggtctgtcttgggtccataaacacaagtcagccacctgtcaccgggcggcaggaagtgcaggctctgtgagctggaggagggggcgcctaggctctgagggctgaataaggggcctggcaaatgcccccggagagccctggagagttttgcagcagtcctggcacctgggcttcggggcccgcctgctgggagcagccgcctgctgggagcacctccttgctggaagcacccccctgccaggagccccccacccccacccaggagcaccctcctgctagagtgccagggagacactgctgcctaatggccaggagcttgcccagggcagtgacttctggtccacttctgtcccttggttgtgtccctaagacccagggaccctggaaggttcacctgtcggtgtcacacggttccttcttcacacagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaataatggaggattatttaatactaaaaagaaaggggcggccgggcatggtggctcacgccagtaatcctagcacttagggaggccaaggcgggtggatcacctgaggtcaagagttcacgaccagcctggtcaatatggcaaaaccccatcgctaatttaaaaatacaaaaattagccaggcatggtggcgcacgcctgtaatcccagctactcaggaggctgaggcacgagaatcacttgaacccgggaggcagaggtggcagtgagccaagattgtgccactgcactccagcctgggtgacagagggagactctctctccaaaacaaacaaacatcatcttctgggggaggggggaatctattagtttaaaataaaaagaggcttgagatcaggaagcttgcatccaaagaggtgtggaggaggcgtggacgagggtggagttgtgtggaccaatgccgagaacaggcaggcactagaggcaggctgaacagagcagagtcaaagacaacgtttggttcctggactgagaacccagctgccggcagcccaagttgtctgatgggagagtttcctaatgtccttgaatctgcaagatgcaagactttgaatggcccttgcccacagcagtgtggagcagttgatgcccatgaccttagggacctggagtcctgcggggtttgaggggggcaaagaaaaccattcgtcctgggaggcaaggaagctggatgtcaggaaggctgccccagtatggaactcagagcaagggggacatccaggttcccttctgcgggcctggggctcttcctaggggccagatgccttctcatcagtacacgaacagaggcgggggcagccagcagaactcctaagacacaaaatgagtgaacactggaaagggagctgagacaggcctgcagcaaagaacagacacca

SEQ ID NO: 127 - DNA, 26335 bp, Homo sapiens
  source 1..26335: mol_type = genomic DNA
tggagacttttaagttgaataaggtataatttctgttgtgaggacttgtttcctttccaaataatatgtgtggtgtctgctgagagcctcatggtaacatttaattcttaaaagagcctttgtcttgatagattggtttcataaaactgttaagaggttcagccaggcaccgtggctcatgcccgtgggaggccaagacaggaggatcctttgagctcaggagttggagaccagcctgggcaacatagtgagaccttgtctctaattaaaaaaagaaaagaggttctttgactattgactatactgatcatatatatactgtataatttaataccaatcccttaagattcctgtgtgtttttgttaggagtcttttggttttcttagagctgtggtctctccacctggagtgtatgtcgggagaaagctcctgtcggggtgagtgcaggcagagtggccgaggagctgggcctctgtgaagtctgggtgcagcttggaggctcatagtggactgggagcttggcaggaggggcggtgcatgtccacaccagtgcccggtctccgccgtgctgcggccctgtgggtctctgctccccactcagcagttacgctgcaggacgttccttcccctccctgtgtgtgagggctgggtccttcctttctgatgtagtcatctttgatgggactccatctgcttgggcccaggggtccccacaggagccagctgtgttcacatcctagtggtccctggtcctaaaccacctcctgactttcctctgttgcttcagcttcagctctctgcccactgcattgtgtcgctggattttcaagattaaattccccccacaagagtgtttgatgcttccctggatggccaggctgtacggccagtgttaaaagacagacaagtgccacccaggggcaaggggagtgtgtggttcaaagtccctgagaacagatgccagatgccaggctcaggtggtgccgtttacttccagcaagaggagagagagggtgcacttgatccagtgccgggtgatggtggcccctaggccagggggtcgcaccctcactttgggctacagtagaaggagattcccccaccccgtggggtcttaaacacagaaaactgggggcatgcctgagggccactgatgcaggtgctaaggcacaacagaggagccatggaggcagaaatcgggaaagacccctcccaggtgagggctgcacgggctgtggtgagggtgctcccctcggtgggctctcggcccagcacgtggaagacggcgcagtccactgccttcccaacccagagaggccgatcagctccgcttagcttcacgtggtcctccgtgtaactggcccatctgtgggttggttctgagggagtgaggctgccctctagaatcacctgtgactggagggctgggtggcaggatttaaagcgcatagcagaaccgggaggattacccatggcttgtataaggaagagtctcttctaaagggttgcatgtgtggcaggctccttaatcaacatgctgcttaccccggactggaacatgccctgaagtcaagtcatttttgtgtagaatttttaattataagttttatttttataaacaaaaatcttagctgaagtccaataaaatccaagaagaaggcacagataatcagggagaagtaactcaagatttgaggaaatcaagagtcataaaagagtgctttgcaaaactttgcagataaattggaaaacttgtatgcgatgcataattttctaggaaaatataaatgaccataattgacctcagaaaagatagtaaagaaaaataaatggataaacatagaagaaagagaaagttaccaaaccattcctcttctaatcctcctccctctgaaggatttcaaacttgaaaagaacacaaaattattgaagacttctttctgttgtaggaagatctctaaaacatagtttctttatctattaatttagagacagagccttgctctgccatccaggctggagtgcagtggcatgatgttggctcactgcagcctccatctcctgggcccaagtgattctcctgcctcagcctcccgaatagctgggactgcaggcacatgccaccacacctggctaatttttgtatttttagtggagacagggtttcactatgttggccaggctggcctcaaagtcctgacctcaagtgatctgcctgccttggcctcccaaagtgctgggattataggtatgagccatattttttgttttttttaaatttatttttattgatttgtttttatatttttagaggggtcttgctttgttgcccaggctagagttcagtgatgcagtcagcttactgcagcctcaacctcctgggctcacgctatcctcttgccatatccttttgagtagctgggactacagatgtgtgccaccatgcccagctaatttttaatttttttttttttttgtagaggtggtgtcttgctttgtcactcaggctggagtgcggtggtgtgatcatggctcattaacctcgaattcctgggctgaagtgatcctcctgcctcagcctcaggagtatgtaggactacaggtgtgagccacagtgccagcttaaaatacgtcaaatttaaaatgcaaaagaagaaagtgtattcaacaggtttagtgtatgcacatatgactgatggagtcagccgttcctgcttgtcatatgtaatgtgtgtagctgggtgtggcatatgtgtacatgggtgggtagatccctagatagatggagggcaagtcggtggatctgcccctcctccactcactcagatgccttagagtgaacacggaagggagacatcagcctgtggcctccttagtcgttctcattttccttcgcctcttggtgtcttgctgtgttgactgattctagttttgaaagcagcatattgggtcaaaatacatttttttttctttgagacagagtcttgctctgtcacccaggctggggtgcagtagcgcaatctcggctcaccgcaacctctgcctcccaggttgaagcgattctcctgtctcagcctcccgagtagctgagattacaggcatgtgccaccacacccggctaatttttgtatttttagcagagatggagtttcaccatgttggtcaggctggtctcaaactccttgtaggtgagccacccgccttggcctcccaaagtgctgggattacaggtgtgagtcaacacgcccggcctcagaatacattttaaatcaggtctgtactgacttcagaatctaactccagaataaaatttgattctaaggggcaacagtaccacaaatgaggcgaagcacagaacatctgtcaccgtgacttggggcagatgcagaatgggactttcacctttttacacaaaacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcactgaatgcataaaggctaagcaatgcagcagtgatactactaaccagctcttagtttactgggtgacctttggctggttctgtcgagtggccactctacctccagtttgccctgtctggagatgcagccaggactgtagattcccaggggagggctgacttactggggcatttatttactggataggggagtttttaatcttttagttggaatatttagtccatttacatttaatgtagttattgatacactgtgtatctggggttaaatccaccaccctcctatttattttagttttgtctcacctgttctttattttttctcttttcttgatttcttttgcattaagcagtttaaaaaattattccattttctccttctattagtgatgtatcagagaatacataagctacatatttgtttcgtggtaaccctaataaattactacatacccttactgtgagaagtgttgaagttagcacttgcaccacttggccagacagtgcaagaatcttgatgcatttaaccctcctacccacccccctttactttgcatggtgtcaacatcatggggttggagtttctatgtggattttaaaccccacagtatacagtcaatatttatttagatttatctgcttctttacacttattaatgttctttattctttcctgcatttctgtccttctgttcagggtcatgtttcttcaacctgaaaaacatcctttaatatttcttttagggtgaggctgccaacaacaatttagtttctgcatattttacctctatttcatttttgaaggatatttttgctgtgtgtagaattctatgtcaacttttttttaagtttaaaggtgtttttcccttcatctcctttctgttaaaacgtcacactgactgtaagtcttaatattggtgctttgaaagttccctccccgcacccccctgtccagctgatttggtttgtattactttacggagatgttcttagctgtggactacttcatatgtatcctttttggtgctccttgaacctgtggcttgatgtttctaagtactatcacttaagacactggttctctgccattctgtctcccctgctgacgctcattggaataggttagaccttttcaccatgtcctgtacatttctcatgttctgttccgagtttttttcttgctgtaggtcactgatcctctcctttgctgtggggcacagtctgctgtttagccaacctaccaaattcttgattccattgtatttttctattctgtgatttccattcgattctttatcaattccagttctctggtgaaaattttcaccttgttatctcttttcttgtacacatcagctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccagcacactcggctaatttctgtatttttagtagagatgtggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatggccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttctcttgggcctgctcatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccagccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtggttaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataatttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacagttaccacatttcccttagtgtagcaggcctgaggggtagcggagaggcaggttgggcctccactagacaaagtttatcctagtgagttcttttgggttcaacttgtcaaggagggtggctactgagaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccgggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagacggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacaatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttctttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcacctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaaaaaaaaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctgtttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttattgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtctttgaagtgcagtaaagaaagtgtaacccaaaaactgaacagtaattcctaaacttggcacttgctctccactctggagacattctaggtttcatttgagagggattttggcctgcttaaagcattttaacagcttttcgttggccccagtacaaagtctaaactctttacctgggaggaaaaattgcttttgatctggtccctgctctctaccacagcctcacctcccaccttccctcccaccagactccagcctcacctcccaccagactccagcctcacctcccaccttccctctcaccagactgcagcctgactgctgacatttcagtgtgttccaccttttcaggcgtttgctgggcagttttctcttcctcaacttgttaaattctattcatgcatcgagtcttgctgttgatgtcattttctttggaaactgttcctaaatccttaatcctttctaccttacaaaagaataacaaaataaaccccaagaaagatctactcctttattctttcacaggatatgattcctactccatcattgtcttcaactgtatggtgtgttgttgcgatgatcgtggtagcaggattgatatcagtattgctcactggtctctagtcttctagaaaataagggatggggacttccaggtagctgatgaaatggttgtgtcttaggttcctgtctccaaagtatttcctccagaataatgtagaagaacaagaaggagaaaagtaaactttgtaaaagccatgtcctcagtgtgaaagacacaatatactccaacttgaaaatcgtaaaaagaggtaacacccaatccaacatggaattcctgatgttctccatctccccactaccacaaggctctgtccaccttgggttgtaggtagttgacagaaaattataggtacaagtttgcagcagaaaaagacaaaaaggaaggagaaggaccttttgacatatgggtggatggcgaaaggaagaagaatcagcaggggaaatttagtgtcctgtagacagggacaaccacaggttgggtgtggtggctcatgcctataatcccagcagtttgggaggctgaggcaggcagatggcttgagcccaggagttcgagaccagcctgggcaacatggcaaaaccctttctctacaaaaaacaaacaaatagtattgtacaaatgagtttctggtctcgttaattatactattgttatgtaagacctaatggtcgggcatgttgggttaaggccatgtgtactagctttgcaacattgctgaatatctaaaattatttcaagataaaaattaagaaaggaaagcagtggttatgcctgtttatacttgagccagagcaacgcctgactcagaatagacagtcacccattcacgttttctaacttcagattgtgcagttgtttgttggttcttgggtttttaaataatgcatgaagaaggtggaaggagcggcgccctgggattgcagtatcgtggtgttgagtcacttgcgatctttccggttcagtgactcctcagtgtgcgtggattggggccctccagagatgctctctgtctgtgtgtgtcatcgcagccctctgctgtccatgcccgacaagccagtggctttcactgctgtgtggggtgggggcgatgtttgtgtttgttttattccaacagtggcttcgtttctcttccagggcatttctctcgctcttcacaagaagtggcctctgcttcttctgattattcacactgtccattattgattactccttatcccctttctttcctctgcatgaaaggcaggtctctgccgggcgcagcggctacctgtaatcccagctactcgggaggctgaggcaggagaattgcctgaactcgggaggcggaagttgcagagaatggcctgaaccccagaggtggaggttgcagtgagccgagattgtgccactgcactccagcctgggtgacagagtgagactcccatctccaaaaacaaaaaaagaaaggcaggtcttttgtgaattgacggctaggctcacttcctggagggcagtcggctggctcaggcacagggcgggaggaaagaggcttccgcacagccacgttctcctcattcctcacctcgtagaaaagatttttggggggtggtggttaatcat

SEQ ID NO: 128 - DNA, 18379 bp, Homo sapiens
  source 1..18379: mol_type = genomic DNA
ctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccagcacactcggctaatttctgtatttttagtagagatgtggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatggccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttctcttgggcctgctcatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccagccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtggttaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataatttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacagttaccacatttcccttagtgtagcaggcctgaggggtagcggagaggcaggttgggcctccactagacaaagtttatcctagtgagttcttttgggttcaacttgtcaaggagggtggctactgagaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccgggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagacggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacaatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttctttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcacctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaaaaaaaaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctgtttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttattgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtct

SEQ ID NO: 129 - DNA, 139802 bp, Homo sapiens
  source 1..139802: mol_type = genomic DNA
ataactgttcttcacattgacccattgcttactaattttaaaggcacaggaataacctcctagggtgcacaaccaggtcccacttgaccatgtaaagggcagtgggtatcggcagttgcctaggggatacccagccctgcttctgccacatgaaagcaacacccaccacgtgcttattagctgcctttcttgattatgcacaacaccaatgggacaagcagagacttccagaaagggtctgctgatgtcatgtggctgatgtcattggtgaagctgcaatgcatggatcctgtccatttagagactcttgccatggagtcacactccatgctgacttgtcaagcaagactttccagctgggtcatagccctgtgcctggccagccagggagtgggcccacagaaatgggaatgcaggctcagagggacatcctactacctccctgcaacatgaaaacaaagcaaagtgggctgctggcctcatgcatgcatgcatgcacagtgtgtgtgcgtccacatgtgcatgcacgtgtgtgttggggtggattgtataaagcagggagagggaatatgggagagataaatgatgaaaaaaatgagcgaaaaattgaaccagatttattctgacaacgtttaggcctgtgactctaatattataaatcactttcttacagaggaatttacttcctgagctttacacaactttataagcctggcatgtgtatgagaacagaacctagaaattggagatgggaaaatgatggtttgtataaatgtggtttgaaaccacaactggtgattttgtcaatgcaggggcttcatccgcctggggcccagcactgcaggaagttggtacagcttaggagtttacttccaatacttccaagataaaattttaaagagcagaattaaaaaatgttttgtggtggccacatggccttcaactctgggctaaaaagaaattaaagggaatttataatctggggatgagggcagtattgggctgtcaatagaaggtactcgttcaggtaatccttatccagagatgggatgtccacatgaacagtacagatccaaactctctttctctgatcctgtcttcaatgatatccatggctctaacatgttagtgggcacacatggctcagaaattgcggctgatttaatgaatgaaggactgaatacagaagaaaatctgggaacaacttctaaaacaacttctatttttctggtcccaagaaaaaactcagcatgggtataacctaccccagtacctctaattgtccagttcttaacttctttccttatctgtctttctccttggcccatctcttcccaaagacacacacatatgtgcatgtgcacatgcacacacacacacgcatgtacacacacactcacatgaatgcacacataaactcacatgcacacacacatacacacatgcatgcacacacaaactcacatgcatgcatgggtgcacacacactcacatgcacgtcacagtgcccttggctatatctcttctaccccaacattaaagcctgctttccagaaaccctcccagcttccctctcaggaaactgagttccttgaagccagaacattatcctgttatgcatcttggtcttcccagggcgtgcatggcaccttacaggtgctctgtgagtcactcaggcacatagtgacagatcgttacaaaaacattacaaagaaatgaagcttcagaatttggaaagtgatgtcagcaagatggtacaataggagtctccaatgctcgtctccttgcagaaaagtaagtttgaaccacaatcaacacataaacttaccttcagaagagttaaggaatctaggtgtgagattactgcacttgtgtgaagcaaataaaacacatattgaagagagtaggagggacaatttcacattacttgtgtcacctttcccctaagcttatgcagcacacagaaaaagaccctctacatgggagaaggagagtgaggtgaacacctgactttgttgtggaccccagcaccaggcttatcccagtgaaccctgatgccaggccagttcccacagccccatgctccaggttgtcacccatgaacccagtttctaggcctgtcccagcaccagggtatctcccaaggactcagccttcaggcaagcctctgtagagtcagatttcaggcctaccacaatgccctctggcccctgtgtcccaggctccaggttgacccccatagactcaggcttcaggttggcccctgtgaacctaggcttcaggcccaccccagcatcatgccagctcccatctccctaggctctaggccagcccatgtggacacaggcaccagggctgcccaccccctgaccttggcaccaggccagcccatctgcacaccctaccagccagcctgcatagactctctggacaggctaactgatgcagagctttcactgttgaggcctatttgtaaagaccaaaagacgtgtgtacttcttcaagtgcatagacaccaatgcatggccacaagaatcataaataatcatggaaacatgccatcaccaaaaggacaaaataaagcaccagaaactgaccctaaacatattgagatctattaactgcctgacaagttaaaattatcatcttaaaggagctcagtgagttacaagagaaaaagatagacaactaaacaaaatcagaacagcagtacaagaacaaaatgagaagttcagcaaagatatacagatgattaaaagaacaaaacagaaagtctgcagctgaagaacacaatgactaaactgaaaaatttgatagagatctttaacagcagtctcaatcaagaagaagaaagaatgaacaagcttgaagacaggtcaacaagcttgatagactaggtcactagtctatccagtcagaggaacaaaaaggagaaaaaggaaaaagggtgcagaaagcctaggggacttgtgtgacaccatgaggtgaaccaatatatacattatgagagtcccagaaggagcagagaaagagaatggggaagaaagtttatttaaagaaataatgacagaaaacgtcccaaaactagacaaggaaatgaacatccagatccacgaaattccaaaaacccaaaatatattaaacataaagagaacttcactaagacactaaacaaattctcaaaagtcacaaagaaataattttgaaaacagcaaaagaaaatggactcattgcatataagggaacttccataagtttaatagtgaatttctcagcagacaccttgcagtgcaggacatagtagaatgatatattcaaatcattaagagaaaaaaaatcctgccaataaagaatactaaaaccagcaaaattgtccttctgaaataaaggggagataaagactttcccagacaaataaaagatgaagaagttcattaccactagaacttccttacaggaaatgctaaagagagttcttcaaattgaaatgaaagtgtatgctaacaacatgaaaacatatgaaagcataaaacttactggttaaaactaatatgtagtcaaatttagaattctccaatactgtaatgtggggcataaatcacttataactctattatgaaagttaaaagacacaaatattaaaaacaactatagctataattattaatggatactcaattacaaaggtataaagtgtgatatcaataacataaattgtgtgtgtgtgtaagtaaaaatatagagactttctatgtgattgtagttaagctgttatcagcttaaaaagcctatgaaaattctaagatgttttatgtaatcatcatgataactacaaagaaaaaaaaaccctagtagagacagaaaaaataaaggaatcaaagcataccactacaaaaaaatcaacaaatcacatcacattgtatcccataaatatgtacaattattgtgtcaaaaaattttacaatgacaaaatagcaagagagaaagaaaccaaggaattacaaaacagtaaaaaaattaacaaaatggcaataatgagtacttacttatgatcacgaattactttaaatgtaaagagattctccaatcaaaagacagagtggctgatcagatttttaaaaaggatccaaaaatatgctgcttacaagagactcactttagttttaaggacacacataggctgaattgaagacatggaaaaagatatcccatgcaattggtaacaaaaagagagcaagagtggctatatttatattaaataaactagactttcagtcaaagtctgtcacaagagacaatgaaagtcactatgtaattataaagggataaattcatcaagaggatataatcattgcaaatatatatgcacccaactttagagcacctaaataaaaagcaaatattgacagtactggagggagaaatagatagcaatacaaaaatagtaggagacttcaaaaccccactttcaacaatgaatggatcattcagacagataattttcttttctactgtttaaggaaacagtagacctgaataacactatcagccaaatgggcctaacagacctatatagaacattccatccaacagcatcagaacaaattctttcctagtgtacatggaacattatccaggatagatcatatgttaggccacaaaacaagtcttaataaatttaagaggattaaagtcatatcaagtatcttttccaaccacatagtataaaactagaaatcagtaacatgaatgtagtagtctgttttcattccacacggctggggaggcctcagaatcatggcgggaggcaaaaggtacttcttacatggcgatagcaagagaaaatgaggaagaagcaaaagcggaaacccctgataaatcacatcagatctcgtgagacttattcactatcatgagaatagcatgggaaagacctgcccccatgattcaattaccttcctctgggtccctcccacaacacatgggaattctgggagacacaattcaagttgagatttgcatggggacacagccaaaccatatcaatgaagaaaattagaaaattcacaaatatgtgaaaattaaacaacatgctcatgaacaacaatgagccaaagaagaaataaaaaaataacttgagacaaatggaaatggaaacacaacataccaaaacttatgtgacgcagaaaaagcagtgctaagaggaaagttgatagtgataaatacctatgttaagaaaaaggaaggatctcaaataaacaacataacttcatacctcaaggaactagaaaaagaacaaactaagtccaaagttagcagaaggaaggaaatggagatcagagcagaaataaaagaaacagaagctagaagaacaataaaaagattaatgtaactaaaagttgtttttttgagacagggtcttgctttgttgcccaggctggagtgcagtggtgcaatcttggctcactgcagcctcaacctcccaggcttaagcaatcctcccacttcagcctcccatgtagctggaactacaggtgcataccaccatgcccaattactttttttttttttttttgtagagatggggttttgttgcccaggctggtcttgaactcctgagctcaagggatctgctgcctcagcctcccaaactgctgagattacaagcatgagccaccacacccagccgaaagataaaattgacaaacctttaactagactaagaaaaaaagagtagattcaaataaataaaatcagaaatgagagacattacaactaacaccagagaaatatgaaggatcatatgagactactgtaaacaattatacacaaaaaattggataatataaaataaatgaataaattcctagaaacatacaacctcccaggactggatcaagaggaaatagaaaatttaaacagacctataattagtaagaagattgaattgggtataaaaaaatctcccaagatagaaaagcccagagcctgatggctggactagtgaattctaccaagaccttaagggcaattaatgctaatcctcaaattctttcaaaaaactgaagagaagggaacacttccaaactcatttacaaggccaacattagactgataccaaagccagacaaacccactgcaagaaacaaacattacaggccagtatccctgatgaacttagatgcagaaattctcaacaaaatactagcaaactgaatctagcagcacgttagcagggtcattcaccattattaagtgggctctatatctgggatgcaaagatgattcaacatatgcaaatcaataaccgtgatacagcagttaaaacagttaagaatacaaatcatatgatcatctcagtggatgcagagatgcatttgtcaaagttcattatccttttatgataagagatctcagcaaattagatatataaagaatgtacgtgaacacaataaagacgatatgtaacaaacctatagctaccatcatagtcaatggggaaaagctggaagattttcctctgagatcagaaacaagacaaacacacctactctcaccacttctattctacaaactggaagtcctaaccaaagcaattaggcaagagaaagaaacaaaagtgacccaaattggaaaggaagaagttaaattatctctgtttgctgatgacataatcttatctacggaaaatcctaaagactttaccagaaaactgttagaaccaataaacgaattcagtaaagttgcgggataaaaatcaacatacaaaaattagtagcattttaatacaataacaataaactatcaggaatagaaattgagaaaacaatttcatttacaacactataaaaatacttaggaataaatttaacctaaattagggccttctgggggctggagggaaatgatgcaagaaagaggaagaagaaagcctgtcctctctcaccccatggactctgaaaagaagaagggagatgaaagagactcaagacagttggttgacagtgtgctctttcctgtccctcttgctcccgaggcagcacttcaatgtgcattggacttgcattacaaagttagcgaggtaaggagagactttatatcaccgtggcatatggtacatttacccagcacaccttgaaggagactgcagactccagggaggctccaagatctcacatggcccaagagcaggagtgcagagttgggtgagccaaggcagttgacaaagattttttgtttgaccaacctttagtcaggctcctgaagcttctccttggcccatgcatgcacttccatgtaaaatctcgttttagcaagaaccctgttaagacagtttaagaaccttctgtccttgatgtctaataattcttgatatttgatccagttccctatcctccaccatcctctaggtgatgtatgatcaccctaccctgtcttcagcaaggactctgttaggtcagcgtagccagaatccactttatcctggatgtttactcttagtaattttccattcactgacacccctgctccttggctataccttcctacttgctcaggatgcattcagagttgaccccaatctctctcccccactgcaaaatcccacagctgtggtccctatacctattgtgatggtcctgaataaagtctaccttactgtgccttaacaaggtatcattgaataattttttctttaatacagtgaacttcttacagacctggcttggcctgcagggagtagagatgagggatgcagaggggcaaggagattgacaaaggtctggaatctgcagcaaccagggtatttatttatagctggaggtgaatgacttgggcttggaccccaggtgtgggtgctggcaagacttgtcagcaagctggatggataagttctccttaggggtcctgaatccagaaagtggttagagcaggcattctttgcagagtcagcaggattcagacactactgcatgggtaagaggacccctgccagtctcctcccaagccacctgtctccccaaaccctctctcccagaggatagagggagggagagcagcagaaaggagaggaaattggcttgaaagagacggggtcactgaaaagggactatttataccagaagagatcaggatagcactagctgaagtgtgtaagcccactgagatgggtactagtgaagaaaaggacattatttttataaaataaataaattatattcatttttttgtctagattggaacctctcttaaagagtgtatctcttatccctctggtcagggagaacaagataagtgactgggttgcccagatcacggtgttgtttttcaaactttcttgatggtggacaatgttctttggccagcaactctggttatcctaagtgctgctggccagtgctgtggggcctggaatatccctggtgggatctgcagcacctcagtcgtcatggtttgctctgcatctctcctccttctgtatgttggctgccatctcctctctcagcacccgctctcctgtgctgccttttccagatggtggagggtgcatcttcacggctccgcagattcctggttacagcagagccatatgtagacccactgcagcccatgctccagagatggggagcaagtgtccatcccgggaccatccaaagatgccacagtcagcactaatatggggactgaaggttcctccgatgagcaggtgggcagttcccagagaacgaggcaggggtgtgctgcacccactcctggcaggtgctgccccttcttctttctgggcgtgaagagcttcctgtctccatggccaggctcatttttcctgtctagaatgctcctgaaatgccccttcctgcataaagtctttcctagttttgtttttgtatttcttttaggacacttacctgtactgtaactattttgtgctctatgcagtttgcctcagggatagcaattgtgactgttcaggctttggagcacacagtgccttggaggtgtcccaggttgatgttaaattgagttgtttataaataagtgaccaagattttgacaaagattttttgtttgaccaaactgaagtcaggcccctgaaccttctcctagacccatatgtgcatttccttgtaaaatccagttttagcaagagccctgttaagacagtttagcaataacctttcatcctttatatatatatatatataaaataactgtagattccagttaattagtccgatgtaattatacatcttaggacaccacacaggcaagagtttcatatcctcttccttcattgtctggaccagaaaaaatatattatagtaatgttatatatatataaaatataatgttatatatatataatgtaatgttttatatatatataaaaatataatgtaatatattaaagagtgtatctcttatccctctggtcagggagaacaagataaatgactgggttccccagatcacaggtgttgtttttcgaacttccttgatggtggacaaggttctttggccagcagctctggttaccctaagtgctgctggccagcacttatatatataatatatatatttatatataatgtaatatatatgtatatatgtatgtatacacacacacacacacacacacacacacacacacacatatatatatataatgtaatgttttctggtccagacaatgaaggaagaggatatgaaactcttgcctgtgtggtgttgtaagatgtataattacatcagactaattaactggaatctacagtgctggggacattgaaacaaggttcagctacatcatatgaacaggcccactcacccagatgaggctggcaggtctgtagaccactgggggtctgccatgccagtcattgcacagctttagcaagctccatctgctacctgtgaaccagtgctcagctggctaagtatatctggaggatttttccttcttcacagcgtcaaacggcaggcggcaggcacagaccagagctggccagttcctccatcagggttgtgtgcagatgtcgactgtccttcagggggtctagatagcctgtggccctcagacaccctgtgtgaaaacccttgtcttcaaagtgtatgcaggaaggaggctgcacaaggacacagataataggggctctgcttgtgatgttctcaagggcaggactgcagcttagcagcttctaatcgttgagaacccaaattcctcatattcaccatattttgtcctttaaaactatacaaggttaagtatttgcatccattgactacaccttgcacacaagataccttagttactaagatggcaaggaacttgctcaagactgtacagctttcacactcccgcatatacccaatatctagcacaatgcgtgacacactataggagtaattaattgtgctttgattttaattcaacgtaatttctctttaagttcacaaatttttcaacttattatttttgtgggcttaaggaaacatactctattctcttgtaaggcagaggtaaatccagtgctgatattgatgttgaaaatgttaattacaaggatattgatgacaatattgttgttaacacaaagcaaaaggcaaagattggagaggatcaatcctccagatgtcacattttgagccctccatttttgcacatggaatcttttgctgctccatttcctcactatctactgaaacaatccaagggagcattggtttaatatgtggctggtgacacccaactccacctggctggtcatgggctccacctaacacagaggccacgcacagccccaaaccctccctttgctcttcagcagtctttgtgctactccctgagctttatttttaaaagcctcatgggggcagtgaatctacaaatattgtatttcaatctacaatgggctttagctcaaggtcagaagctatgcctgagacagatggcccagggctttgctggcacttcagggaagtgtgttagacacacagaaatggtctttgcagttgcttatgatgggggtggagacaagagcctaaggagagggttttgagatttgagatgctcatgatttctttgtccatgagtaagaagtgcattttaatctttctgcagccatatcctgccatctggccttgtggcaaaatccagagaattgtgcctgaagaccaaaggcagaacatggccctgactcttgtgtaacttcccccaaagtcctcgtcagtcaggagacactattgtgctgccatgggcagcagtgtttgataaacagcagtcccgcatttccctcccatctgtgtacgcaaaagaatccataaattagaatttcatgcctcatttttatttctttagtgctaaatgcaatgtcaacttcgaaattcccaggggcaacagattgtgaatattcaataaatcacgccacttcttttgcactgttttcttgtttttatagtgatacagttgaactaggtaattttcaaggtccctttcaggtcaaaatccaactatttttgagaatcctgagatccaatgagcactgctcaaaggctgaagatattaacactggagtaggtggcacacagcctcacatctcctacccagacaggcaggtgccaaggacatagcaaaaggcagcagtgtttgtatgtgaaatttccactttataaagcacccttacgaggctacctatgtctgctaaagctgggaaatcctttttttctttgaaggtcctagctggctgcctccttccactgatgctccaggcagcattggggcacagtatgatggtcaggggcgaggagatggccagcccttcacagctttccctggcatcaacccaaggtaacttagctgatgccctgtgtctcagctcttcatctggaaatgggtaaggaggatgctgtttgtgacatttgtgtgtccacaggttggctaaaggtttgataatgagtatcagcctttgtaaggtgcttgccagttgacagagagcttccatcttcatgctgtcttatccaccaggaagactaactaaatattattattattgtcgcccttttatagatgaagcaactaaagcaccaaggagattgagtgagttgccctttgtatgagagcaagtaagtggcagactcgaacccagatacttagacgctaatccagggctttcccctatgccacactgtccccaagcaattctagactgaatctgtccataactttgtttaccatcattcttgcccatgtaatcacttggcatgtagaccctccagctgctgccttttattctgtctgtcccttctaccttatttgcatttctcattacgtggtgctctcaatgaaaaggaactttagtgattactattttgtttactttgttacatctatactccccaaggaatgtttaatagataagcagttttggaaaaatatcaaggaaagtgagcaacgatctatcttgatgcctacaatgaacaaaatttgctcgtgcagttctcatgtccatccttccatccaaccatgcatccaacccaaaatgtagacacgcatcatccactaatccttccatccacctttccatccatccatccacataccgacccacctatctacccacctatccatctacctcatccacccacatatacatccatccagtcacctaaccacctatccatccatccaaccatccactcacctattcatccacccatccacccacctattcagccactcactcactcacctacccatccatccacccatctgtctatccacccacccatcttttcatctatctacccacccacccacccatctatccacctattcatccacccaaccatactatctacacaacccacctatcaacccacccattcacccatccatccacccacctacccacctacccatccacccactctttccaccaatctaaccatccacctatccatccacccacccatgcacccacccacccatctatctacctacactcccatccactcacccatctactccactcacccacccattcacccatccatccatccatccatccatccatccatccatccatccaatattggctatatacctactattgaccaggatgtctgaaatacctctggctacgatattgagcaaaaactacatgggaccttatcgtcaaagaagtaaataggtacaattatgtgtgaggtgcgttctggtcgggggggtgcaagtgtaaatggagccttctgccactctggccttaagcccttgtttagctcccatgttccctcacaggcattccacgaagatggttgatttatcatcaaagggcattattcttttggtactttcacaggctgacttatcccatttagttatccatgtgtatgtgttatttctttacatgtatgtataggtgcttggttgcttgagctgaaatcccacacttggctagagcagattaaaggtgcggtggcctttccgagcacttattactttgtgaatgtccaaggtgcttttgtgtttagctgaaggtgatgatgggcttgtttttgttttggtggtatggcagggagggaggttgaaagagggtatggaagggcacagcttcccctctgccctctggtctggactggcctttaaggagggtgcatttggggccaagaactaagaaagctcttctattacagacattatgagactgagttttccccgttctgtcaggttcctgcattcatctggcaccctaaggcggctagctttgagcattggaggacagtaacagaaggaggagactcacgttctcccagtgaaccataagcaaggccaaggagggggccctgccagtcttcagtgtcatggtgcccacatgagggagtctgagaggagaaggaggtggtaggtgcagctgaaaggctgcctgggagaagggaagttcccgcggacacgctcaggaatcttctaggggtgcggctgctgagggtcctggggtagcccgtggaagagacgggccaggaagccccacctcacatccctaatgcatagagggcacaggggccggggacccccactcacacaggctgcatttgctgtgcttcttcctccaccgcccagggccaagggtcagattcacctcctccgcgccttgttttgcagcctgcgcggctgcagggacatgtggggctctgagcaggcgcggtgggcaggctcctctggtttgtgggagtgctacgaatgcctgggctcaaagcttggccttgatgacgtcttaacagtggcttcccaagttgccccatggaattctctcctcctggtgtttggctgctgcaccccgtgcaggcctgtcctgctgcggaaactcctctccctcctgccgcctcaatacagttgactcctcccgtgcctgagcgccctgcttgtcagctccccgtggtcctctccagggtccggtgctttccgtggaatgtccagaaaactccaccttcctctcttttggtgctcttcacctttccacctgtgatggaagccgcttctgcgcagggctcctctccccctctctcccatcttctcctggtcagcgggggctgtgggggagaattttgcctcctggagagcttggcacatactggacacccaaccgaggacagcggcgccttcctgctaacctctcctgtcaaggactgcttattaccaaggggcaaggacgactcctttatatgtcacctcagggcagcatttaagtcaagatttaaaattctcgatgctgcacaggagaagtcactgggacaaacaatttcctttggaagttacagtttgatgcctttcagcgagttaagcagacactgagcccaccctgaactctaactgtaggcccccccttttttaaaacaaacaaacaaataaaaacctagcattatgggcacatagatcatggctataaagagccacaatggaaaccccccaaaagccagctcaattatcagcatcaaaactgctgagcatttaaaggagcatctcgacgaaggtaattatgggaccagcatcattctgctcattctcagtccttcagcctatacagcgcactctgagatgatgttttcctcttgtttatttagttgatctccaagagcagggaggatttatccccactaatccgtggaccataaatccagctcaggcgggctgcagccccgtcctgcttggccccaagctcagatgcccagtggaaaacatcacagtgattgggtgagggcagcacatcacgctcactgttctcattctggccgggagattccttggcacaacttgtcccaaattccattacagcaacgtgatggaaatttcctggcatcaaggatttgtgcagcccagtgtgcacacagtgagcatttgactctgcatagcaaaaatgacacaatctgtatagagctgtgtggttagtaaaatgctttcacatcccatcccaggtctttttgattctcagaactatctgtgaggtagccagggcaactgtcaaatgcagtataattagagttctttggtggcaagtaacagcaactgatttttgctaactttagcaaaaaaggaatttattgggggagggaggatatagagggactcatatagttgaaggatcagctaaagaaccaggctgagataaatcggcttatattgtccatccttgggaccctatgctcatgagtcaaatgagctgggagaaattccaagaggcccagcatgggtcagcacctgtcccctgtgtagggtggggtctctttgctgatagaggcctgccaggaggatcaacagtggagggttattggggccagagctgagggagtttattctcaaaatgaatctgagattctcttatcaggttaaggaggtcgataggtcgaaaccgaccatgtgtatcatcacctccactttgcagataaggaaatcaagatgccaagaagttcagtgatttatccagaaagccacaaatgtgaagctaaggctttaattcaagccatctgactgaagtccagtgagctcccagcctgcgttctgaatttattgtggaaacaatgcaagatcagcaaagaccactttgaagatacccatcaagccaccggtgtaacatttgcccatttcttcccagacttgccctcagttcattttctttgtcatccagtttcagtcccagtgtccctgtgccctgcccactcatccgcattctcctcggactggtatcttcggcaggctttggttttatggtgcaaatggcaaaccaccaacagcagaaggaagttttgtttggagtcaggggatgccttgtaagttacagaaatttacaagggcaaaggcagccatgtgctcaagatttaaacttcctctagatgcttcttgacagaaaccattgggacaagtcttcaacttctgaaattatattttgaaggcagtgccacacttttgctgagggtgagtgggtggattactacatgaagggacagtaggagatgcctctgttaatggattattctttcatggggttatccacacaaaaacaacacaactcaatgtcaagtgccttttaggcctccctttaattttaaggatctgaagaaggaggtagcagatggagacactgagccacagagccacacacctacagccatatgataaatcagccatgagtccagagaaccaagtctacttttcctgattccagaggctctggatgaagtcaaagcaattgtgttccaggtgcttgttgctgttttcaagatgagtgcacagccaacattggtgcctcgatgggcctatctccttcctggaatggtaagccacagtacccgtcccaaaaggatgagctctgagaggagctgagcgtacagggactctgagacagagccccagcattgtggaaaatgtgatggctagaatctgaggacacctgggactgttatgtttaaactgccaacagctcttctgtttttctaggtggaagtttgggttattctttccaattacttctttgggggaaaagacttcaaagggcctttggttgcatcctacagtacatcggggagcagccacagtcacatggaggtgaagaaccctttccttatgttctgttcagttcttgcctatggccaagctaagccctgttggatctgggccagagccaggtgatatttactgccctacacacacttttggctcccatgcacctcggtcaagggtccctgccctcttgaccagggcggtgatggggctcatggagtggtgcagtgccctggtcagctggtatctcaatggcctggactctggagggaaggtcctgggtgcctcctttctttcttgcccattgttggggaacagaccttgcgggatgggctctcttggctcctagcttgggattttggatgaaaggcttggacctctgctccacgagtggtgaattgtaattctgatttaaatatgatcagatattttagagccgtatgaagggaagaaagaagtgcatttatgatccagttcttaaaataagaaacttgaacttactagtctgatagcatggactgacataattgcattctgcagatcatcatgcagagctggtttagataaggtatcttttctcccccttgctgatttttggagagggagaggccctggacactggtagaggcaccattataaaagcactcagaggcgggtcgcagtgtcacatgcctgtaatccgagcattttgggaggctgaggtgagaggattgcttgagcccaggagttcgaagctacagtgagctatgattgtgccacttcactccagcctgggagacagagcaaatgagaccctgtctcaaaaaatttttttttaaataataaaagcattctgaaagagtggtggtgggtaaatcacacaattcgtctttctaattgggaaactcattgggtgaaaggggcagctggaaacaaccagtccaggatatatcggatgatagctggactgtaactgccatgcaagctgagatactggagggctggggaccctatggacactgtttgcagctgtatctggcattcatttttaatatatttcttttctcctcttttttgtcattccccctgttatccacaagtcctcaatatatttttgtagaagttacagcccgatcttagtgctgggaaaatcgagggaggggcttgtgtccatggtagcaggaaaggatacaggaacagggacagagcctggggaaaccgctgtgatagcaggcagtggggtgcacgtcctccttgtgatgaggcagccagccgaggagaccaatgacagcagcctggacccacgggctctgcagatcttctatgggcgtcccagagcccttttggagggaacttggtgaaggatggggttccctgcatgtaagtgtggagtgggggctggactgtcgttatctgggcattgagggccatatggatagcacagaaccaaagggacaaatggccactagactaccctatgacttggctctgatgactcccagacaccgtgccattctccttgctccgccttatcttctgagagtcctggcatggctccctgaccctccacctcgtccgtgttactctacaatgacaggccacaatgaggacacagagtcagcagagggccaggcagctgttcacctctcccatcacacccaggtaaaactccagctcatgttggcccacctcctggaaaagtctctctgtcaacagcatttcaggatctcgtattcagaagacaacagctttagcgaggagggcactgtgactgcaggtgggcatctgtgcttccgcccgtgtgggacccctgggacacttacgctgggggaggatgtggttagtggccacacaaatgcctaaatccaaagacattggaaagtgaattaattcactaaaaaataggttgtttctttagtgaataaaataacttagatactcctggatacttcattgagtcatattttggatgtttatttttatttattgatgttcctataccacagggatggacacggtggctcacacctgtaattccagcactttgggaggccaaggcaggtagattgcttaagtccaggagttcaacacctgtctgggcaacatggtgaaactttgtctctacaaaaaataaaaaaattagctgggtgtggcagcttgcgcctgtagttccagctacttgggaggatgaggtgggaggatcacctgaacccggggaagtcaaggctgcagtaagccatgatcgtgccactgcattccagcctgggcggcagagcaagaccgtgtatcaaaaaaataaaaaataaaactgaattcactcaaaaataggttgcttcttctttagtagataaaataacttagagacttcattgaatcatattttagatctttatttttatttattgatgttcttatgccacaaattattgtgagtccatttaccaaaatctcacaacacaaaaggaaaaaacagttggagttagagtgaccataaaataagagataaaataaaggacaccaagaccaagaatggggaactgctcatcttccaaatggaaaagcgcccagacagcaagcccttggtggcaacgcagtgcattgaagggtttgttcttggctctctggtgaggcttcctaaacatctccatcagggatgagggtctcaacgtttgcctccaaaagtttttcagaactagacaagtcctcctgcctccatagtgactgccccaagttgcctccgttcctcctgcctgggcagttaaagtcgatattccctgactcagtcttttatctctcgtaacctaagtactcccgggttgagttcagctattctggtcatgatctgactcttattttgtcctctttcctgagctctaggctccaatttcaaacttcttgcagctagttccgcctctgggccctgcagacatctacttatcaaatggaactgaactgtgtttctgcatgtctattttttcatgttggtgaatgacattttctgtctggaatgcctcacgcccttgcttttctgcctaggaaatcactatcgatcttttaagcccttcttaaatgtcaccatgtctctgctgccctctgagtcatcaggatgaagtatccacactctcctctgttcccgtggcacgggggctctcctgccatcatcggcctttaggggctgccatcatttgtctgccttcctttattttttttgagacagagtctcactctgtcacccaggctggagtgcaatggcccaatctcggctcactgcaacctctgcctcccgggttcaagtgattctcctgcctcagccttccgagtagctggaattacaggtgtgcaccaccatgaccagctaatttttttttattattagtagagacggggtttcatcatgttggccaggctggtctgaaactcttgacctcaggtgatctgcccgcttcggcctcccaaagtgctgggattacaagcgtgagctactgtgcctggcctgtctgcctgtcttattctagagcaagggcaggcttgctttgatggaatacacacacagactgggagctggcactgtgcttactagcttactagcactccagacatgcttgtggatgaatgcatgagcagtcaaggcaaactctttcctgactggcaggaaaacagtcactgtgaagtacagtgtgccccacctggggaggcagagcagagatggcttctcatcctagtgggcaggagcatctgcaggaagcaggaacagagcatcctgcagaggccactgtaagaacaggcagagcagagtatgttgtttgtgtctgacctcagggaagaactacagagaatgaatgctgtgctccaaaacttggcggtcgaaattatttgcctcaactatgataaaaagtttgcctgcagctggtcagtgccctgctgtcttcacctctgaaacatcccaggagcacttgaaactggttgtgttctgggagattactcaaggcaatttctccctaagcctgggaaaacacgagggctcaattaagcaaaacactgatagataagttaagaatgtaaaggaaaaactaagagctttatgtcaatgattaagtatttctgtttctttaaagcttgccccgtattatgcaaatacattacagttaagtgttggctacataacattggaagaggatgtggttaatggcaaaacaaatccccaaagaaaaaaaaagttgaaaagctgattcatcttaaaaatatttcagatgacttaaaatatttaaggttcattttggactttttgacaagtaaagacccaaatatgagcaaattaaaccattaaggctctttcagtatggaatgacaaaaagtgaaaaagggtaagaccaccaggttgttaaaatcatgagaagcttagattgggcaaaggttcagtctggaggccacagtaaaggaatatacccgaagacaagaaggtagttagtgtcagggcctataaaaatgtttaaaagtgttgagtaaaataatgttttatagagtacattactataaatacatataagaaggccaagtaggggattccaagttatgtctgggtggcattactgaattttgtaagaagtgacagaataccgtactgggtgaaccatcccttccatagcttgcctggcatttctcaagtgtgaatgcagttcactcaagttcctggggtgtcccagaaagatgcgtatgttttgaaatttattaggagattgaaaaactcctgatgagtggtcattgtaaatcagaagtgctttcagcatggatgggtgaggagcatgggattaagtagggacctctgtcctagtattattttctctgttgaattcatcctaccagttgctgagctctttatttgcacacatcagccttttaggaaggatctccaggaatcctgtggggagaggctggtgctgggggaagacagaggaatgcctggagaggacagaagtgaggtaggtcaaggtagagggggttgcaggaagaagatggggtgtccagggtgaaggagagctagcaacgagagcagaagccacggcccactgacggtcgctccgggccaggcttctgttctgtgggtacacggtttatttcaggggctgattctctttagactcagttttttttctctccttcttctgattggaagaagtttaattccgtgttcatttccaattcttgcattcaagcttataatttatcattaaaaaacaacgacaacaataaaaaaggcaaggcatacagaagggactccaggcagacattgcagcagggcagggcagtgaagggacgccacgtttggcgaggccttctgtgtgcccagctgcacatggccacctggccagtgtgcatcgtgtgcagtaaatgtgtcaagtgcactgctgcacgaaccatcagatgctgaaaaatcttgtcaagtagaactttctctatccccattgtatagatgaatgaacagagctaggaggagttgagtaacttgctcatggtcacaaaactgagaagggcagagctggccggcacctgtgttaactactgcactcaggctagaaaaggcattctaatcaattaggacctggggactaatctgaaatctctaattcatagtgaaatccctggtgaaatttagaaggagattggacataggcctgaaggaacattggctcaaccgccttcaggaaggtcagtctatgtaagccagttaaagaatatgttatgaaccacacaccagtccaacaaaggccatggtgtgattgtgaagggatgctggctccagcctcagcagctcagtttggacttggctttgtggctgggtgtgctctgtgatcagggaagtctgcagccagggaatcctctgggcctttctagacatctcagcaaccttttagataaatggggcattggctttgtttgatgctaaacatttactttgattgctttcattgatagcatagggcttctcctattttatcttggctgttctaagaatgtctggaatggggccgggcgcggtggcttacgcctgtaatcccagcactttgggaggccgaggtaggtggatcatgaggtcaggagattgagaccatcctggctaacatagtgaaaccctgtctctactaaaaatacaaaaaattagccgggcgcagtggcgggcacctgtagtcccagctactcgggagggtgaggcaggagaatggcgtgaacccgggaggcagagcttgcagtgagccgagatcgcaccactgcactccagcctgggcgacagagtgagactccgtctcgaaaaaaaaaaaaaaagaatgtctggaatgttcagtagaattcaattatttgaataatgtttatgtgtgtcctctgtgtgccaagcgctgggttagagtcaaatgtgagcagtgcgtactccagcactgtcccgtagaaccacctatgatgacagaaaagctctgtatctgcactgtccaatacagtagttactagccgcatgcagctaggatgaccaaggggctgcactttagtaaactttaatgaatataaatgcaaatcgccacatgtgtctggggctaccctattggacagcacagggctggattaatcttgggttgtattttgaaaaattgcaaactcaaaaaatattacatatactggaaatataatgtacaattgttaaaattttagtaaaattatatattatacactgatatattgttgtaataaaggtaaatagaatttctatgtattgatttattcagacatttaggtggtgtcttctatgtgacaggcactgtgctagattctgtgagaatgcaaaaatgacttgtaagacagttcatgtttttaagaaactcacagctttgtagataagtgtctacactcacacatgtacacttacacacccacacatatgaataccaggtaacaaactgcctaatgcccttaggtaagcatgcctcacaaccatcagatcactgacaatagccgtcatcagatccagaggacacatgtgcatttctttttaagaacaaaaagttgatctcatggaagtaaaaagtagaacagaggacactagaggctgggaggagtagaaggataggtaaggtagggagacatttgttaaaggatataaaattatatctacataaaaggaataagttctggtgttctgtagcactataggatgactgtatttaaccataatatattatatcatttcaaatagctagaaggatactgaatgttcccaacacaaagaaatgataagtatttgagacgatggatatgctaattaccctgacctgagcactatagcttctatgtatccaaacatccctatataccccataaataggtacaattattatatgtcaaattaaaaaatacttaaaaaatcaagagggggataaaaaagaactaggaaacctttcctagaagtcccccagctgacttcctttcatatttctttggtagaatttctacgcatgtccatgcctaaacctatcccagacaagaggaatggaattgtcatgattggcttaggccagtcaggatttagctcctcttttatggatggatacctgaacaaaaatcagggttctgttagcaaggaacaggggcggtggaatagaattgcacaggcagtcactgtccctctgaaaatttacccatcctccaaatcagaaggagcctctccattcatgacaccccactcattcctctatgacagcactcacagaagagagtgtgttaatgtgtttgctcaagggcctgatttcctgttaaggattgtgtaaccacaacgcactcttctctattaaactgagagctcgttgatggggtagggcaagtctcattcatctttgaaaacgtggcactcagcgtagtagttcctggcatatccacagctcaataaatatttgttagatcgaatatacatttgttcaagagcaactcaattaatatcttctttcttcatttgtttttcaaagactacacctgttggtctggattgcagctggaattggaagggaaatgcatttccattgaaggaagaagtgtaacagtgagcaggcaggtgtcagcggatctcaagagaataatgtcaactggacaatggcttagaggcaggaggaggcagatcagctaggcagatgtgcagaagttaagtgtggtttcatgcagaaacttccaaatggattcaagagccaaagccttcaagaagttggtgtcattgtcacttggaatatgtttgtattaatacaggtagaatatgttaataaaccatattcttatcaagaatcttccatttacagcccttattttctccctttatttttgccctttcttttctgcctggctgtttaactcctggatatctgatttaactacatctgcagcttctcactgatatgtttatgggtatcagatgcctatattgcgattgcttttcctgtctctgggaattagatgtgatccatgtacacctttgctctgagttagatcttagaaagcaatggacctgggcctcattatctcagctctccacagaaaagcatctaacaaattgagacttaatgttacatcttcagctttgtggagggaagctgacatagaaatgtgcttttgaagaacaaacctgggtattttgcaaaagcatagtggaagactttatccatcatattactcgaagtccttttcacaataacctgcaggacagaaaaaaatgtttgtttctccaaattaaccttcaattggcctatcgatgtcaagcatatcccacccctactgtcaccagggacttaggactgggttttgccccagtggtggcatttatccgatcctggtgcttggtggcatccatttatttgctcctttcaactgattttgattctgtttttattatttaattttctgttttatattgtggttaattttctgagttgcctcaaatgtttatgtttgagtgtattttttttcttacttacctatacccatctacctcccacctacccacccacttacctacctatgttcctggctatttatatggtgcataatctctatcagcccaggcttctttaaagtacctgcatgttcttttcctttttcttctttgaccagatcatacctacaaataatacagaggattcagagatgggagttccagagacgtgggtctgattccagctttgcctcctgctaaatatctaatcctgggcaagtcatgtagtctctaggtgttccagtttggccaactttaaaatgggaataattctgtctacttcacttatctcatacagccagagtgaggacattcatattttggcatataatataataaggttgtagataaagcgtttattaggataaagtctttggctaataggttggacagaccagttgacctcctaagggtatcatcataagaactcgaaggtcttattcaagtgtttccctccaataattctcacatttccacctttagatcttttattaaggatcctgtgggaaatgtgtatttcataggttattaacccaacgaagtcagatttctatttcaatctacttatttcacatttttgttaaaacttttgaagaaaatgaatttcttattgaattcattttagactgctgttagctcagattcactttgtgagttagaatgcctcttagaaatatataacacacagggaaaaacttttgggtgagtctttcttttttgatagtaccacatgagtccgcagtttgctgatccccatgaacatggacttaatcttctttagatgctttaggacatgtggttatgcagtcagggagctgagatctggggcaggagggtgtaggaaaaataagtgatcgtggggagtggaatcagaagacagagtgggggaaggatgtttctggagcactttgtgttcagtcgcagaccggtgaggcccaggagaactttctccagctgaggaggcccaggtgaactttctccatgtggggagctgttgagaacttgagcttccagcataaacacaggctgaacctggctttggcgaatgtgggcctccagcccatttacaaaatgtcacactttttgtatggcttggaggagactcagaagtgacttaggaattccatggagccctgatgtagccattggcagttcccaagcaggaagccagtccctccatttcttcccaaaattctcccaaccacaccctgcctcacctcctggctgggacatctattactatgatcattttactggtgagaaaaatggggtgctagaaaggttacctgacttgctgaaattcacacacgagttaatggtggggctggtgctggagccaatgttgggcctcataaactcctacaaagtgtgctaagactggccactctttcctgcaggccgtcctcagggtagttcatgtagctgatgaccttgagaaatgaggtaatgtcttccttcatccccaaagagcagactttcttactgtttgctataaaagcagtggattccccaaactcagtgttcctcggctgtgacacaaaccgccttcatgtgtgtattagttaatctgagcctgttgggtcacttctgtggaactcaagggcaagggtaactgatgaaatatgcttgtgttcatcttgcttgctacgttaccagtcctgtatttcagatccagaagtctcatgtcttctgccagcatctgtgaaacaggctaatactgtcttataagttggataaaataaaatttaagacctgacccccagcttcctgagtcctggctggagctttcccaccatagcactcagcttacgtaacccaatccaagaggaagaaatgatggtggcattgctagctttgatccaagtttttctttctttctttctttcttttttttttaacacttctctgggcccgggctgctgttaccaggccttcagtagatgtggataacaggtaggtgactggcttgctggtaagcagagatccctggaaaccaacccaggccaggccagggcaggagcaaaaaggaagagcaagagtggagaggagtgaagagtctttgcactttgcaaagacattttgatgcctcatcaccatcttatgtagctgtcacatcacaaaaaaaggaataagggtggagaaagtgttctgctaaatgcatctgtgtcctagggacacagatctatgaaatggggtaggatgatgaagcaggagggaaggctgggcaagtggggagcagggcggcaccctgtgagaggggagggccactgggagggcagaaatgggaaagatggtgccatgtcaggatgtcgttgcgatcttgccctcatgatattcaagttgcttttaacctgctgaccaatttctggcaagaatcctaaagaaatcttagacagtgaagtgagatctaaccatgagtgagtgtcacagcctcttcacactggacaatctcctcccacattcggcccatagagggggaggcccactccagccaagacttgtcaaccagaaacctgaaacgatagcaggtgcttctaaaataaccttcccttcagcagataggcctctgtcatacgacttttaattgcttgtcaaatatttgactaaaattgagtagttttccttcagggaaagttggtactcttaagtcactagcaaatgagaagttggtaaaaaaaattggccagagcactctgtgtgtgtacacagcggcgaacggtcaatacataacaattttctgcactgctagagattctgtttaatgtttaatttaaaaaatgaccacttatatgaggtatctaaagtagtcaaattcatagagacagaaaatagaatatggttgccggggcagcggggacagggaaggggtgagctgctgtttgatgggtgtagagtttcagttctgtgagatgaaaaggttccagagatctgttgcataacaacatgaatatacttaacactactgaactgtacacttaaaaatggttacaatagtaaattttatgttatgtgtattttagtcacaagtaaaaaaaattgtagaggaatccatgtggaaagtgaacacagtattgatttttatagttttaacttccctgactgatctaaattaaaatgtccctgctatgggaaagggtaaaagtcagaaaggaaataacttcccttttactgaattttagtcaactccttagacaaagaattggagagagatatatatatgtatatatatatatttgctcacacatgtaaataatttgtttttgtttttgtttttttgagacagagtctcgctctgttgcccaggctggagtgcagtggtgcgatctcagctcactgcaatctctgcctccagggttcaattgattctcctgcctcagcctcctgagtggctgagattacagatacctgccaccacatctggctaatttttgtatttttagtagagatgggatttcgctatgttggccagactggtctcgaactcctgacctcaggtgatctgcccaccttggcctccccaaagtgctgagattatagtcataagccaccacactgggccatgtaaagaatttgaatacacttcttcacatttcagtaaagctctttgcatgtttttttgtacaaaagaaaatcatttcaatacttgttaacttcgcagccattgtaaaagatcactagtgaaagatgcttctgggtatacatccaaaagatttgaaatcagtgtcctaaagagatagttgaacacctgtttgcatagcagaattatttacaatagccaaaaggtagaagcgatccaagtgtccactgacagatgactggatctactactcacacaacggtgaattacatattcacacaatggaatattattcagccttaaaagaggggaaattttgacccatgctacaacatgaatggaccttgatgacattatgctaagtgaaagaagctggctgcaaagcaaaagacaaatgctgtatgattccacccatatgaggtacctagagcaatcaaattcatagaacagaaagttgaagggtggttgctggggcttccagggggcgtggtgggggtgagatttcgtgtttaatggatactgaagttttgttttgcaagatgaaaagagttctgggggtggatggtggcagtggttgtacagcaatgctaatgtacttgatgtcactgcactgcccacttaaaaatggttacattttttgtcatgtgtatgtaaccacgattaatacaggctataaaaatactgttaaagaaaagagcgctagttaaggaagcaactcatcatttcgccatctgggtcattcattttaggagccgctggccaagccatgagctgggctcacaagactgataagagcagtctgcataactcactctggtgctccgcatccaaaaccaacagggcctaaatctggttgaaacccataagtcctgcctcactctcactctcttctttctgacacagaggtcctcttgtctggatctggaaagcagttgaaatacataggacctgcccctgcccgtttggtgttcttcccacattctgcagcatttgcagtccccttcatgcatttccatgtgtatgaggaagattttccaacatcaaagtaatttttgcctttcatcattaaagaaagcctttgattcaaccacaatcatctctgaatgaggtaattcctctgaatgtttcacttgtaagaattggcaattcctaagcaagaccaccgccatattgattaaagacgtccacttggttggcccttccagcctcgccaggtcaaacgtaactggaggccggccttctcccaccccagcaagctgcgtggacaggcgactgtgtaatgggaaagctgtgccatgagaacgtgtacttcctccacaaccacacgctcatgtgttgttttgtaagcaacatttctgctgaggaaagagcagctgggcacttaagactcctggcaaaaccataatggtggaaaacaaaacttaacctatatttcaagaaaagctgtgttctgttcccctgatcagcattagcctgtaggtatttagttgaattaaatgaagggaatgatgaaattaatccacattaaaaagcaatgaatagtggattcattaacccagagaagaggtggagggctgcatcgtaaaaacaaagctcaaagccaaggctctcgcagccacacccctggggtggctaaaactgcagccgctttgttaattctcaatgaataattaaccggaggtagaaatatttttgagttttaggagctctgtgtctgtcggtgcatcgactgtttaatcggaggcctctacagtcggtagttttggttcaccctgattttagacctctcttctgttcttcctgtttcaagctccaaggtggctcagtccttttcttcctcctgctgaatcttagggggaaattctagaattatcatcatcatccccttttacagataagaaagtagaaagttaaacaagtaattttctcaaagtcacatactgagaaagaggttggatccgggaaggtgaaagaggttggatctgggaaggtggattcagtggattaagtgaattaagtggattaacagcctggcccttaccccacctgctggattgccttatgttactggggtatttgctccccgtttcttccggcttcagtcaacaggggccctgccactgtcagctcccaccataggaggccttctgctgccggtcctgaactcagagccctgtgggcacagtgagacctgctgggccctgaaaggagagcagagagcagagtggccactggccttggaggatcagagtggtgatctggatgtgctgggatgatgttctggttgggttttctagtccattctgcctggggtatgacagaattcctgctggcagaatcccaatcctccccttattgacatacatggttgctccctaggaggcaaactggttctgggatggggaggctggatggcctcagctgtctgcctccagcaggacctggaaccctgaccacccatctccctggcctccccatctgtccttgtgggtttgatatgaaggggcatgggcactatctgcccaccttaagaatgagggcagtagggaagtccatgattttcttcagggggtctggaaccctccctgaagggtaatattctagcatttcccttactaaagcagaacatcctccactgcattcaacacttaccatgcacacgacacaaggctggacgagagctatgtggctgggtcccgagactggcaggcagcttgcatgcttgatggaagcaaatccttgctaagatgtttctgtttcattcgacacctagatttcatatgtcccaaaattacttacttaaacttttcttttttcattttatactttgaggcccaataaccatgtaaaccttggcttatagtttcctgactactctcagagggcgtcatttgcagtgatgtttcttctagaccttttttttgggtacattctccgggttctattgtatacttcactcttttctctgaaatatgtgattattgtttaaaagcactgagtgacaatctacataaggtggtgtgtgaagtactacggtattcctgttattgctactaggtttgagtccatgacatctagtatcttcttgcctctcttccttttgacctgacagttaccagccatccactcccctctggaaactgaaatctgcacaggcacatttccttcacaaagagttcacttgaccctgacccaaacgtcctcaaccttgcatttgacccagatctggccctcctcactaaagcctcctgcactggcctccatctgccctggggcccttttcttctcccagggcagttgttttggagtctgtttatggcctgtgcagacacttggctgaaatttacctcagtctctttccttttttcattgaagttcttatccattttctaatcgtgtcctgcctccaaaagaaatttctctgttatggtcttcttcaagcatagttctctaaatttcaaatggtttagacagaataagctgtgactgtagaattcttgccagaataagctatgactgtagaatgtgacaggataggatgccacctcctccccggactcacatttgacttggactttgcctcccaaatcctcctggacatccatgtgggacaatgactgcagacctcattgcttctctgcccactccttcccctcatttgatgtgcttgtcacgttactggggtatctgctccctgtttcttctggcttcagtcaacaggggcccggtcactgtcagttcccacgataggaggccttctgctgtccgtgctgaactcagagccctgtgggcacagtgagacctgctgggccatgaaaggagagcagaggcctaatgaaggcttgtggctaagcgccagcatctttcacaagagggatgacaggtgaaccaagtgaggaagaggaggagagtgaagaaggaaggtgagctggtttatgcccacagaattcctgcagagttagggctgaacctcactcacacacggctggtggtacctgggcaggacattctgccattcccatgtacagcacggtgggttcctgacacatatctgaggtgttttagtggggataaagcttttcattccactggttgaaaatgctcaggagaagtatgtccaccttgatgctagccacgctaaggtgtgaccgcacctgtgtaaatccttcagagaatgagagatcggctcagaagggaagaagagaaaaccttgggtttgggtcacagagggaaaaagaagacactggggaggggccagggtgttaccctgtgtctgtctctcagttctggacaatctgggctcaagtgcacacaggtacagggacatcagctgggccatggggtctgggaggagattgcctgcttcaggaaagaggtgagaccctggcgatgcctaccataggtgttattatttattatgagtcccagggttgggggatgttctaagtggttttccctcagttgaagtgggaagagaaaaatgactgggtgtgattttatgccgctaatacacagagatgatccgcactctggggcactttaaagtcagcattttaagaagcgttgtgagtgatgtcgcagctgtgaatgggtcttgtccttcgcagtgaggtgaggactggctttaagctcctccagtctgccccacaacatgtgaaattccctttgtgcttggtgtttgtgaaagaagtgtccactcttgggacgagagcatccttatcacaagtccgggctctggagccagctcccagggttttcatcaggcctcgccactggccagctgggcggcttcgtgtgagttactaaatctctctaaacagggtcagtgacacgatttgtgaggcccagcacaaaatgaaaatgtgagacccctttccaaaaattagaagagggcatgcagctgagcacttggcactgtgttactgcctaggttgctgcccgtggagctggcctggtcttcatttcaagtggattgaaattgtgtggattcaacgcgttattactaaaaaggagcttagaatgggcattcgtgttactcagaggtgcgacacacaggttcagagaagagccttcactggggtcaggcaactagggtttagccttgctgtcccacaaatgtacagggcctcagataagtcccttcaagcctttagggtctctacttaccgaaaggacaggaaaggcttccctacatccctcaagggcagagagaactcgcattctctgataggacgagcaactcatcccagtacgatgggactcccagggtctccctctgtcaggagcaaaccaggatggctggtcactacatttactgggattttgtcaggcttttcctgtgcaacctatgtgcctcgtctcatctcacttaatctccaccacagtgctatgtatgagacagataacatcaccctcctgtgacagatgtgaaatctgagttttgagaggctacgtgtggctggggttagttagaattggggctggactgctctcatctccaaagcctgtgctttcatctgcatcagtgatcctcaaatgttcacatcaaaaaaatggagtgatcctcaatttgttcacatcaaaattagtgggagaggttagaacccagaggttctgattcagcagtttggagaaggggcctgagaacgtgcatttctacagttcccaggtgatgctcatgctgtggtgcctggaccccactttgagaaccactgttctgggccagcgtcctccgtcttgggctttggagatgctcggagagcagctggagagctttgacaatgacaaccaggacgggggtccaccgcagaggctctgctgtgattggtctggggcatggcgtagggggaagggttctggaagctctcccatcatgcaatgtccgggtacagccagggttggggttcctgctctgtaccttgctgtgtcccaatgtgtgaagacgaaatgaggcagtgggtgtcaaacggctctgccacaaatgcaggtgttaggtctcctggccagaacgctgccggcgcagaacccaaatcagatagtcgagtgcatgcctgggcccttacaaacgattaagaccaaatcaaggccaaagaaaatgaataacagatgtctgggagatgctgaggccttaaaagtgtttatcacgtctgactttgagaaaatattggctgggatcagataagaggcaactcccggggccagcggtgccttgtcctaaggtgcccgctgagctcaggaggtgcgggctgcagggccccaagcaggcgcaggcgtcctccagccccggcttcgacagctgactgctttccttctacttggaaaatgcttgctccactttagcccacttgtgatggtgtcgcggagtagcagctgtgggaaggggcttcaggagttgtggtcctgctcagacaggatgcttggcatttggggatgggttggtgaagttagaaacaaaaccaaaacccacaaacacaacaaaacatcaaaataacaatctccccctcaacacccagttaaacttgaatttcagatacgcaatgaaaaattttgggataagtatgtcctatgcaacactcgagatgtattaatacttatactaagaaattactgtccggtcgtggtggctcacgcctgtaatcccagcacgttgggaggccgaggcaggtggatcacttaaggtcaggagttcgagaccagcctggcaaacacagtgaaacccccgtctttactaaaaatataaaaaattagctgggcgtggtggcgggcgcctgtaatcccagttactcaggggctaaggcaggagaatcgcttgaacccggaaggcggaggttgcagcaagctgagatcacaccactgcactccagcctgggcaactagagcgaaactccgtttcaaaaaaaaaattactcgtgggttctctgcattccaattttagcgggcatcttgcgtgttctctgtacccctatctggggagggctttattttcttcaatggcgtccccgcgtcagagcctgtgtcttgcactctccccctgagtgggtagcagaggtgttatcacaagaaggaaggttctggggagtcgaatgacaggcttatgccgctagcagggcgggcgtgccagggactaggccgcttcgcaggttcgcttttctcctttccattgcgctgaactcaaggaggagaagggaaagtggaagctgctccacacacagctgagtgtgcatggctgctatgtgacagcctgaggtctgttcggtgacccccggcccctcaaagggcccgcaaagactcagaattagctccacttaccacggtgcccgcggatgggggtgcggatcaacaccccagcggaaggccgctcctgggcccccagggcctcgctggcggccacttgggggcagcaggcggcagcagacgcccaccctgccggggaggtggggcccgcaggccccaggaccgctctaggagcccggaaggcctgcgcaggtggggggcaccgtgttccggaagcctggccccgagcgctgtgcggggcgcccggggacgctcagcgagtgtctgtcccagccctgagctcagtgaaagattgcagagtcctgggcccacgagggggtctccgctgtgtccagacgcccttcagagcaaaggagccacaggcgggcgctctcccagtgtctctcgggaagcgtgacctcgacttcatgcccgggagaagcggccaaggccgggccgcgcctgtccagggaagcctgaacggccgccctggggtgtgaagggtgcgggtgggggtgaagttcctgaaggtgaggagggactcacgctcggtcagatctgacgggggttaggaaggcaaagagttatttttaaagctcaagaaaaagagaaatgaacttcatttcctttttgtttggctccaattccgtgcctgactattcttttatgctcagggttgctcagcagacactgaggctgtgttttgttccaagggactgagatcaaatattagtttagcgagggtgagaaacatgctctgagtaacgttcattcctgctgcagtaaatctatgagtgcccgatgtgggaaaatcagaccccgagcccagctgcccagacgagcctctagcgttttgcctgtttatggacctgctgatacatttaatgtcgggaagcccggggagggcaaggctaacacccatgcagcctttctaacctcttgtggaactaggaaaacagtgtgagcttccaggagtgtgtatttgggaggggacacatatgcctccacacataacaaaatccgtgtgcatgcttgtgtgtaccgtttacatgtagtgtgtgtgtgcacctgcatgtgtgggttggtgtgcatttctagacggcaagaaattccagtagaacttttgactttcgtactattctacagacattcttttccatccgtcccctgtaatgatgacttcaatgggtcagatactcttgagccttttcatgaacgatctttgctccaagtcttccctcagcttctcactgcctgcatccttccgcgattagactgggatctcagtctattcccagaggtctgagactctcggcagcccagcagtcgtcagagagaccatggcgggagggcatcttagccttcactccttctactgcaggtttgaaactcaggctcccttaaaggtaaaccaggatatcacacagataataatagtatgataataaactcacatttgtatggtgagttaggatttacagtttccctacatttttttcatttaatcccagagccagagccaccagaacgtatgtggtcctcacatgttcctccacaaagagactgatggagagacaatgaggttaggtagacagcaagaacaattttggccgcctcattttctcaactaatttgagatttctcttccaggctgctggtgccaagagatgggtggatcgacaggtcttgttagcaaggacaaaggaaattgttttgttattggcttagctgttatttaaaataaaaacataaacataattaaaaataagcactttggccaggggcagtggctcacgcctgtattcccagcactttggaaggccgagaccgaggcaggcaggtcacttgacctcaggagtttgggaccaacctggccaacatggtgaaacctcgtctctactaaaaatacaaaaattagcctggtgtggtggcgcgtgcctgtaatcccagctactggggaggctgaagcaggagaatcgctcgagcctgggaagcagaggttgcagtgagccaagatcatgccactgtactccagtctcagggaaagaatgaggctctggcaaaaaaaaaaaaaaaaaaaaaaaaaaaaaattagcccttttggtatggctgtgttttctctacacacatgaacagtttctttgaaaggacagcttccttttcctgactgtgcatcatctgaccaaattccaaacttctgtaattcaaggaaataatatactttgtggaaaaattagaaaatatatattagcaaagaaagaataaaggcaagccgtgtgcagccccattactctgagatggccgctgttgctgccatggtgggcctcatcccagacttttctctatgcaagcacaaacacacatgctcaactcagtttattttatttttacaaaacggaagtcattctgtacatactgttttgtaatcaaaatttttctttttgatatatcatgaacattttgcccatcatgaaatatccttttaaattgtatgcaattccactgtaaacatgtgggtttatttgacatctttattgttgggcattttatcttgagtgcttagaatggaaactaattaacccaggataggaaggtgctctatcttttattctgaagatgttattaacatagatttccatggatggtgtaatgggcctctagagggtggggccaggtgtggcgatggcccaggagattctcaggggagcctcttccctcaggagccccaggaggcacctttctctgtctccgtggcatttagatccgtggagtatgttcacctgagtgtgacctacaagcttaaggtattaatccatgttcctcccacatggattaatatccgatgtgaaattagtagggaaaaaaagacgtgctccgtggccactgagcccttcccagcgggaggatgcagaagttggaggaagagatactgttacatcccgcgggcattagctgcttgtggttgggaggcatgcctttgataatcagcatcagtatctctttcatgtcactgaacacaaaatgaggctgcatcaaagagcctgttttagagaagaaattgttgaacaggcttgactgggttgaacgataccagaggggcaggatcagagcacaggccggtcttcccggcccagccaggggcactcactggcctgactgcagttccggcagctcagaggttgtcacagtgcacgcgagtgcctccccactcgacccttccatgtgcttggcagcaaggggcatgagtcacctggtggccaggtgtttgttactctgagcttttgaggtgctgcagaactccaattacatagcctccctgattttttttccctcctctctaatactgactttttgttaatgccaacctactagtagatacttgttcttcttctgacacacttgggcatccaacaaaagcttgcaaaagaacagctttttgtttgcttgccttcaggaatctggttcagtgagcactccagatatggaagggctttataatgattcacagctttctttgctggccttcaggggaacgtgacctgcttaggttcaattttgtgcatgtgtgacataattttcccttcaataatacagacaaaccctgattctaactcccagtcgaacccactggtcttctgatctttttgcattgctagcattatttagtcttaaatgaattacttttttaaaaaatgttagcactatctaaagtgaggaaaactctcacaaagagttttgtatgagaatgaaaacacatgatgtgttttaaacattggaatcccagaaggaagaaacaaggtagtgttttcagttatttccactgaggaggtttaaacaggatagatagtcatgtattaaaatccccaaccactgtttaggaccaagccaaaacttttaaaatagcttttgaatggagaaatgaaaggctcaaaaccactgggtaaagttggaggaggatcgcctcttctccctggaatgcttttgctggtttttgtcctctttggttagatctcactggtctcgttccttctttcacttttaattggactgcaacacccaggcagaaaactcagtcccagaaaggatcggagtggcatggcaaatgtgagatcagaggcaggaaaccatgatgacctcttagcatgggaatgagctttaaagaacagtgctgcctatcctgatccgggtaccaggagacagacagccccaaaggagtgatgtgcattggtgaatccagatgtagactttttttttttttttgagagacagggactcactctgtcatccagagtggaatgcagtggcgcaatcatagctcactgcagcctcgacctcctgggctcaagcgatcctcctacctcagccttccaagtagctgagaccacaggaacacacaaccacacctaatttttaaatttttgtagagatgggggtctcacgatgttgcccaggttggtcttgaacttgtgggctcaagtgatcctctgcctcagcctcccaaagtgctggcattacaaacatgagctattgtgcccagcgagccacagattttctttattaggatggaagggctgaactttttttggaggtgtggtgttggagagttgtgggggggagcagtgtgggcagtacattgtagggcgctgaggatgttgtttgttttgatccataccttggaatcaggagtaacaaatatcgaaattgggcccctaccaaagagtgtacgcttcggtcaatatagggtgaacagccttactaagtaactaacctggtcaaaattattacaagcaagctccaagtaagccaacgcagaccacctggtgatgggaggactttgctaacctctgtgagacacacagcttgggccagtccatacatggtgtttgctttccacagggcttcccggctggactggcacctcctcctcacactgagaagctcaggttcctcactgggccccagcttttggaactcaggccctgcatggcatctcttgtgtccctgtgcttggtaaaaggcctgcgtggttttgggtgaatccatgaagctgggccccagtggactctgttagtggcattctcggtttccttccatccctgcattgctccttctcagatccatcgtcctcctcccacgtagacatctgtctcaagggactgtcctcacctgccttcttctcttcctctccctcctccttctaatattttctcatctcaaccccatggttttgtccatttcctttatgcacgcttggcctgcaggtgccttggggagaacccacattttagttcatctttgtacccagtggtgctcagcacagcacctggcacacagcgggtgctcaagacatttgttaaatatgtaaatgtattttatacattaaacaagtacataaatgatggataaagatgacacaaaaatgaagtccaccaataatgtaagcgttatcttggctggtggttttgcccaagagcagggaagatgtgcccagggggaggctgggaatgccctcttgccctgggagatgactgccctcctgaccacgtggcacacagcatgagcggactttgaatatgtgcacttctgttatgactgcaactgtttccttgggagaaggaaccaaagtaaggaggtcccgtgtaagccattgatacccgaggccctgcaatctggcttctccctgccaagggcatcagagagagcaaggctctcagtgtactaatcaacctgtgtccgtcaaacacacatggctgtgctatgcatggcacaggggaatgacgtgatcagtagtaagaggaagaagacagactggaaaaacccaaaatgtgtgatatcttaatagaaatcccatgattaaatcaaggatcaagtttttttgtttttgtttttttttcagatgggctgttagggtcccttaaaagccacattctctgtcctggcatagccatcctgggttgagttcaacaagtgtgtactgagcccaggacatctatacataggcaggatatgcacacagatcattgcacacagggagcatctaaggccccctgctggtgctggtgctagtgctagggtaatgaagacaagacatttgtctccaagaatctcgctgtctgactggggaggccaacatggcaacgtgtaatttacaaatagcatgtggagtgccctgctatttgtgctcagggacagggaggcacagaggaggcattctcagttcagcccaggggtcagggaaggcttcctggggaaggtgtctttgggaattaggatgggtttctctgtttgagcacatcatcacttatttcctttgcaccgagtctcttgaaagctgatacaaagcgagcttggtagtcttgcactggagctggtttggcaggttgaaatctggattagtaaaccaaggtttccctggattgtctaacttagtggataccttgggacaggcttcctacctcaccctgctgcagtgtgctctcctgaaacaaatgccacaaatgcttgatgtgatttgccactagctggtgcctgggaagtctgggtgccctgtggcactcctgcctgggacaatgtaatggattctggcaaatgcatgtctcccaggcactggaagtgcagagagccatgagctgatactagaggtagctgcactcacgtgccgagtgcagaaatcgtacatccattgtttacacaatcataaatgggagcgtgacattaaaagaagattaaaagaaaaaggaaacaaggaaaacccaaccaaccaggagaacaaaatctttaatcctaaactcccatgaatcagtttgaaaccaaaccatatatttttaatttattgaactgaaaaaataagggcatcagattgttttaaattcagcagatttccattttgtttggcttcctggccacctataggatgactaataagaggattaaagaggctgggtgtggtggctcacacctgtaatcccagcactttgggaggctgagatgggtggatcacctgaggtcaggagtttgagaccagcctggccagcatggtgagaccctgtctctattaaaaatacaaaaattagctgggcctggtggtgggtgcctataatcctagctacttgggaggctgagacaggagaatcacttgaacctgggaggcggaggttgtagtgagccgagattgcgccactgcactccagcctgggtaacaaagagcaaaactccatctcaaaaaaaagaaaaaaagaggattagagagaagctggagcatcctggcacatggcagtgatgagacatcaggctccttccacttgactgctggagagcagttgtgtcatctgcccccaggtttccagtggggctggtggttgaggacacccatgccccatcagcaactgtgcccaggcctcctcagcagctggaggttattctcggcttctcttttccacgtcttgactctcaactcagtttcctcaactgcagaatggagataatgcatggcctgcctcctccatagtgattttgagtttactgtatttgtatatatctatattggagttaactttcattgggctagttgacttcatattgaattttatagacttacactgtccaatacagtagccactagtcacatgtggctatttaaatttaaatctaaattaattaaaattaaataaaataagagagtgacatctgtgaaaatgagggagtaaggatcttcaaaaattcccacctccgtacaagcaatgagaacagtggcaaaaactgtcagaatcaacttttcaggactctggaagttaaccaaaggcttgcagcaactcgagaagtgtttgctcaagaaaaatgtctgaatcttcataagaacaatgagttttatgatgttttaatttgccctatttccatacatacccttatcccctggtctccatggtagtcttgaagatatgcagccttcaattacagagaaaaccagcagccactggagggggcagaatagggatggagtgccttcaaaggcctatttccagagagttgtcagcatttgacctttctgttggttccctggaagatctcattctcaaggctgtctttatttgagttgacttgaagctttccaagtgtaaacagacttttctccagggctgtttgtcaaaaaaaaaaaaaaaagaaaaaaaaagaaaaaaaaatcagaggcaattattgaacatctcagcgacctggataacagttcactggataacagctggggcaaataaaaggctgaccaaaaagcttaaaaagaaatttgggaagtgagacgtccatacagactttgaaaagctccaacgtattcctaggtctctagagagccatattcatgcccagggctgagcacattctcaggaaagactggataaggccatgagctctcatatttgactagccttgagattctgcacaagtgggaagtgaacgataaggcagagttgtaaacagcctggctgagtcacactgagcagagactggtagacttattggttccaggcacttaaagatggcctctttctaatcattagctgatcacaaagctaaccaaacagagatttcagtggccacaacaacaaaggacatggaatttacataattagttcagaaaaatcaccaaccaaacaagcaacacataaagcaatgaataacaagagcaaaatactctagggagtgaggtgtgggggggatctgattttcagagtttccatattatatttgcaagaggacagatccctagatgcccttggccaatccagctcttccccactcttcttgtaattcttgggcagaatgtaccaaggatacaatgtccagagataaggagaaaatgtctggaacaaccacagctgtgtccttattcctcccagaacaggatgttctgcaatgctcaagctcagcaaacaaagtgacatccagggtataaaatgcagagcagagtgctttcagggtccctcagctgggatttcacatggggcaagcacagatgagactccatctgccctgggcagctttcctgagccttgggggactggctcaccataaatcctaagcttctgtttatccttgctgcctatttgtgagtaataaaatctgctttgcctgacttgtgtgagtgttctgtttcaccagactagacttaaaagcctttgcaatattatttaaaatgtctagttttcaacaaaaattatgacacatgcaaaaaatatgaaatatagctttatagaaaggggacaatagcaattaataggaactgtgtctgaggaagccctgatgttggacttagtagatgaagactttaaatcaattactttaaatatgcacaaagagctaaagaaaattatacacaaagaaataaaggaaaccatgaggatctctcaccaaagagacaatgtcaacaaagaggtggaaattatagaaaggaagcaaatagaaattctggagttaaaaagtacaataatttgaaatgacacattcaccagaaagtttcaaaagaagatttgagtaagcagaaggaataattagtgaacttaaagatagatcaatggttattattcagtctgatgagcagaaagaaaaaataatgaaggaaaatgaacagagattaagacacctattgaacaccactgagtgggaccaacataaacacaatacaatcccagaatgaagagagagagacagaaagggcagaaaaatatttgaggaaataatggccaaaaacttcccaatttgatttaaaaaccattaatttaacatccaagaagctcaacgaactcaaaataagataaactcaggctgggtgtggtggctcacacctgtaatcccagcactttgggtggctgaggcaggtggaacccttgagctgaggagtttgagacccacctgggcaacatggtgaaaccacgtctctactaaaaatacaaaaattagccaggagtggtggtgtgtgcctccagttccggctattcaggaggcggaggtgggaggattgcttgagcccaggaattctaggcttcagtgagccatgtttgtgccattgcattccagtctgggcaacagagtgagaccataagactctgtcttcacaccccccagccccccaaaaaaagacaaactcccacacctaggcatgctataataaaactgttgaaagcagtaagagagaagtgactcatcacatataagacatacgtaagaaatattttcatcggaacccacggaggccagaaaacagttggattacatagttgaagcaccaaaagaaaaacaccgtcaaccaagaattctacatccagcaaaacaattagtcaaaattaaagaagtaattaaggcatttccagatagacaaaaactgagataatttgttgccagccgatttgccctatagaatataatatacaggctgaaatagaaggtcattagtaacttgaagaaatccatattaagaaataaagggcacagaaccagataaaggtaattacataggtaaatatggaaggaaaatataaatgtatgtttcttttgaactccttttattctcctatgtgatttaaaagacaactgcataaaacaatacagattgatcacattctgattctttttagtctttatgtagatatagtatcatatgggtcaatcatagttttccatgtgcctatagattgctgttttctgccttaaattttcttaaattaacaaattaaaaaattgcatatatttattgtgttcatgttgttttgaaatatgtatatattatgaaatggctaaatcagctaattaacatatgcattacctcacatacttatttttgtggtaagaatacttaatacctagtctcttatgttttttgtatttttattattacaaataatactgaagtgaccatcacatagatgcattggcatacttttgtgagtgttttacctgtagggtaaattcttagctgagaagttttgagtcaaaggctatatgtaggtagaatttttataagttttgcctattgatttcccaagaggatgctccacattacatttctgttaataatatatgagagtgcctatttttttaccctcactaatacttggtattattaatcttttaaatttatatcaatggacaaatacataatatttcacttacattgcatatatttatttttgaattaggttgagcatatgttcaaacatttttggccatttatatttctgtttctgtgaactgtttattgggcctttcataagcctattaatagctggttatcttcttatttagttgtgagagaaaagccagattttgggggatcctagttaccctattcaacttcggggaaaattcttgatctcagttggattcccttcctttgtctgtggaatgggagtggatgagcatgctttatggaggtgtgcggtatgcctcgcacatctttggtgctcagtgagcatgaatctccttccctctccaaagcggcaatggcttatgttgagctctgctccaagtctctctgccctcctcttctgccagcggccagggaaagcactttgcttttaagggctcctgcaactaggtcaggcccactggacaatctcccaatccaaaggccaactgtgccatggagtagaacctaatcatggtgtgatattttgccacactcacaggttctggggattaggcatggcatcctgaaaaggggttgtgctttttagaatccttcctattcataccatggccttgggactttttctttccttttttttcaaatacagacttgggtggagccctgctagacagagtaggtgaaagtggagctgctgtgggtggagacgggagggaaggctggggctcccctggtgggagccatcagaatgtgatcagtctgcattgttttatgcagttgtcttttaaatcacataggagaataaaaggagttcactcaaggcaagaccccaacaactgaaatcttcaatttgaatgttatgggttgaaggcattgaaggctacttcttggatcatgggctccactggacagggtgaagcatcaaaccgttggcacctttcttaaatagtttattttattttatttttttatatacattttaatttaatttttctaaaaaatatttgtttttcatctttttttatacaaacttttgcttaccctctgcttttaaaatttttattttttatttttattgttatggatttagggatacaagtgcagctgtgttaaatggatatactgggccaggtgtggtggctcatgcctgtaatcccagcactttgggaggccaaggtgggcagatctcctgaggtcagaagttcaagaccagcctggccaacatggtgaaagcctgtctctactaaaaatacaaaaaatagccgggtatggtggtgggtgcctgtaacccagctactgggaaggctgaggcaggagaatcatttgaacccgggaggctgaagttgcagtgagctgagattgcatcactgcactccagcctgggcgacagagtgagactctgtctcaggaaaaaaaaaaaaaaaaaaaaaaaagaggatatactgtgtagtggtgtagtctcggcttttagcggactcaccactgacatagtgttcattgtaccctgtagctagtatttcatctctaacccctcctgccctcaatgtctattactcctctctgtatgtctgtgtgcacccgttgtttagcttccacttgtaagtgagaacatgcagttcttggctttctgtttttctgagccatttcacttaggataatgttagcagtttattggggtagctgttgctgaaatagggtcctgaatggttcagccacaggaccaattggtttggataaaacaggagagagaagcaccagatcctgatgtagctgaggggccgcagggaaaaatcctgtgacatcagggggctgcctgccactaaagggagccctatggcaaagaggaaaacaggtctctgggtgtgagggccaggcctggcaagacgccgcatgggacgcagagccagacagacagaacgcggacagaacgcgagcagctttatgaaaggccgctgtgtgccgcactgactctccaggggggcaggaaccaggcctggaggcgacagggcctggaacaacaggagaaacacagccaggaactgagcttagctacagcagggacagacatcttcaggacactaccaccactgccatccccacgaggtccccgaggctcaggactggacgccagaagcggcctcgcagaggtcagggtctccagcgtgcaccggctggaagcccggatccccacccatggctgccgcctgttgctcctcacatcagcatctaacttttttagttttgcccatttcacttgtttggcagcagaggcgagtgggaaaggcagtgttcagattcccacctctgtgggacaggaggccgggccgaggaggctggaacaaacgggtgttgaatcagccaacttcagcatgtgccgttcatgccaaaggcaggcttctccttcgcactgtaatcaattaaaaacctgttactgctgcaagggcagcgccttttaattgcgattcccagtaagaggtacatgtagcatcatgacctggtatacgtgcacacaccccaatccccatgtaaataatactgagcccaatgtttcatgaaacaatgcctgtacagccatgtactccaatatagacaattacatttaatttgtaaaaacttgattataatttcacaacccacgaatgggttgcaagtagtaagttgagaaatgcttttctagggcttgtttggacttcacataagggattcaaagcagtttctctctgtatcttcagaattctggcagaatcaggcctctggatgttccagggagtgtcctggttccctggctcttactacaagacagcagttcagatccatggaacgtctcgactgttctgcctcacggtgacttgatccatcaactgaataggacagcatctgattagattttagaggcaagagcgtcggctcttcctactttcgaagattttctttcggcacccacttggcctcatgttaccacccctttcctctctggaggagctggagagaatggctggatggatgcatttgggggagtggctgagcatgcgcggtgagatccactcttccgcgtgagctgcgtgcagggagttctctcccaccccccacctctctcccccactctaccttgtctccccaggcagcagtgactgtctgtggggtccatgggggcctgcctgctgtccaggtcagccctctctgcctcttatcagtaatgagctgatgtttgggttctcatctctcacttcttactctaattcccaatttattcatggggaagacagaggctcatttactgggacttcttcagcaatgacactggtctcaacttattggcagggaaaatgaagcagaggatcccagatcccacagtatgttaatggaaacccaaggctagaggccagcgccccaggcttccagccccagcacatctcttgagtactttgctggttctgatgtgccacaaatactaaacaatagcaatgtccttgaggcaatccttggagaccattgtcagcactttgaggtttctatctccattgggcttgcagcagatgcaagtggaaaatggtgataaaaacctactgccctgtcctggtttacccaaggtcccagagccactctaaagccatgaggtggttacatacaggcatggatccatctgtcccaagtgcttgaaacaatgcctggtagatgacaagccttcagtaaatattggtagaattgaatgagatcattagaccattaaaatacttgtttttaatcacttctaagaggtttctagggtggcttcaggcatttcttcttattttcaatccctacaccatcctacaatgattccccttttatggatgcgaaattgaggataaggtcagttggctgagtcatgcaagaccacacagctggtaagccgctgagctgtgattcagatcccaggctgtttgactccgaaacctgaaggcttttatttataacgttctgatattgcggccacagacatcaagctggccatgagagaaatcaccataaagagagccctgctcatgtaggttgcctctccacgcatcaagcaagggtggctttgactttgggaactctattggtacaaagcagtaagcccagccgtcggcatgcagagctgttcccatctgtaccaacgaagcccaaagcttccgaacgtattccatatccacgctgcagcgcctgtctgcagcgcctgtgaatgccaaaaggcacttcgggcacgacttttgtaaaaaggagtattttccaagttcaagttgaatagatattttggaaaatacattctgtagggttcttctgggggtcattttgagaaaatctcacatacccttttctgtggtcccttttatttagtaacacatgcacgcacagacacacgcatgtgcacaatgatggcgggctgatgtggcaagtgtgcctgacgctttctgttgggtggtcttgagtgttgatactagagtttatgcagcagctgggtaattaattgttggagaaattgccaaggatattttcaaacagaagccttcccccaccggccagttactgaatcgggtgtgaaggactgaaagacagcctcctcctctggctgagatgaagcctgaccctcgactccttgaggactcagagtcccccagccctgtccttgtgttctcaggacaagaatatgcgagatgctatgtaatggtgtggagactttagagacacaaactagatgcaggtattcaaattaaaggcatgaaattgactacagaagccagctctatttaagttcacataactaactaggggttttcaaaccttagggtgtgtgaagtcactgtgaagcttgttaaaatggagattcctgactcctactcccagaggggttctgattcagttgacccgagcttcagaagttttaatttttaataagtagctcaggttcacaccagaattccacctgtctggccaactgggcatgtcagaagaggcacaacaggtatacacaggggtgaacttcctgagctttgggcttcctaaatcagacacattacaactttattttaaggaaaaaatggaaaaataacttgaaaggaccaaatggagaaatgggttgaaattgtggttcatgaacataataaagtattgtgtggccaataaaaataacacaggtacactcataatatggaaacaagaaaaaacatgctctcatggtgattacagtgatgtgggcagattatggggaggtaataacagaaataacctgattgttctcaatagtatttaatttcctctactcaattattttgtaaaagtcttcagtacaagctcagtatgaaaatattgtgtgttttgcattttgcattaatactgggctctgtaacaagtagaaagaagatgtaattcctatctacaagaagccaatggctataagatgagcaaaatgtcaagaaatctagaggtggtgtagaaaaattgcagactttttggccagaagatttgtgtttaagtttcaaccttagtaccaaagtggacaaccactggcaaatattttaacctctcttagagccagttttcacacctttcaagtgagaataacaataactactaccttaggagttgtgataatggtacatgaggctaataaaaataaacataccttataagctataaaatgctattaaatataaatgtgttttccgcaaagcaaaacagtgaaatgtcaacttaagaaaactttcccctttaaggttttttcacttatgagattagaaacccatctttggcttgattaatagtgagttcttgcaatcaagcatctctgagacttgtgtgtgtcagacagcagagaggatacgatggcatcccagggtcaatcaagcacaacgtgcactgtggtcctggcatgcactatcaactgaagctgtgtccaccaacaagcccatgcttgtctttgtctgtagagggtgatggaaaagcccattggggagggatggacacagtcacctggagtgtccattcactttcctcctccccaatgccctgcacacagattgtgcatccagctctggctgtggacctgtggtgtcgtgatgacctgggacagagagcaggaggacgttccctttggtgcctctcattccctatgtgctggttagcacatcattaggcctgatggaaggctctgccaggccctcccccaccgagggccccatcaacaggtgagtggggtccattttgctggaaagactctggaaggctggagaagagactgagtgctctctctctctcctatgggaaggcagtgagctagtgccctcttgggaatgcagtgggagaactcaccagatgcttccagcaaagccgggaagtgctagtgaattacacgatgatttccacactgtttatcaaagatcttctgctccaatataaagctcccaaatatggtatttcatgatgtggctgagatgtggccaagtgtccaagacacataaatatttatgaaataagcaagcaaatgcacttggaaatgcatttctgcctcagtattaatgcggtggtcattggcattgattctcaaagtgaggccattttatggatcattcccagcagggactaagaaaacatatcaatgtccagaacttttaagatccaggaagcacagggggagagtaatattttccaagggaaggtaacatttttacacccagagagtcaggaaccccattcagtgctgagcacaggagaattcagaggcattagcttctgtgagacttgggttcgagtcctagctttggtcctctctgtgactatgtgcaaaaactccacctctctgaacttcagttgctttgtctataaacgctgtccatgtctcatggggttattgtgacgattagatgagataatatgtataaagtgtctggccaatatcatgcactccttaaatattagttttccttttccttgaattattgtatttgttttgaaaaccttgggttctaccaaatctcacattccttccccaggacgttcctctcagtcctggtgtgtatatgcagtgaaagtgaatccacatggtcttcacttgtgtctactaaaaacatcaaaatgttattccagaagatttgtttgatgttcaaaatactaaagcggcagcactgagtggcatgctctgaagatgcctgtctcgctggattttaaagtggcaccagtcaatgcctttagcatccctccacttacagtggtcctagagataacatgggcttataaaatagcaaagcctggcacatgattgcactttttgctgtaaaatgctttcacaaatattttcccatttaatcacaaaacagctctgtgtgtgtgtgtgatcaatgcaattgttgtccagccttacagatgggtttaagtagaatctcagaggtttcacgccacttgtctaaaggcaaaaagctgataattggcaatagtaggtttcagatcatattttcaaaggtagagcatcccacagccacctggagcctagaaattagaggctgttcaacatgattcatctctccctttgccttactttttcttggtttcctatgggaatttccacaggggttttagcatttagaaagatctcgtggattcattgctcaatgagcaaagtcactgagggccgggctcagtgaaaattttgcaggctgaataattaaaaaaaaatctgggaaggatcacaaaattgagggccaaatgggaccttcagaggtgctctcattcctggaggcattcaggatttcattccacaattttgattgcagtcctgctgtgtgccgggctctgtgcagaatcatgacagccagtgtcaaccatggtggatgtagtcctagttgtcaggactttagggccagtcttcagccagccctctaagttcacaggtgaaggaagagacctgaagaagggaaattaccttgctccaggccacgtggctggttagaggcagattcacactcgtccaactccggctaagcttcaccccactcccaccaaggccactgaatttagaagagaaaagacacccaacgcaactctttcctctatgtagcagtgggaaaagtacaaacgcccatcttcctggagagctgtcccaaagctttggatttttcctctgatcgctatgacatggttcatagtgtccacttgatgggtactcgtggaaggaaaatcagacgtgtttccatggtcctcacctggtggctaggtctgggtcccacttgctctcagcaagtggccaatgccacccctatggtcctatgggggctggggaagcctctcagtgcgcactccccggccacctcttcatacttgggaaggtccagtgtgccctgagccccattgctcctgtctctgcttgggaccactgctttccaggggaggaaggccagctccaaggaaagttcagattattttaggtggggcctcataaacccaggaaacaggaaaataaccaaaagaaaaaaaatccccctgcacagatgggggattggtcctaaaacatcaggccctgttctgtctaaatcaagacatctggtcactttttttcggcaggacaaagactcttttttttcccaagccaggattttatgtctttaatcttttccagaagaaaagagttctcattacgtctgcatcttatcacatcactgtatatcataaagatgccgttatcgcctcttccttctgattaactggccctgagtgattctagccagtgttattagctgtgctctaaaaacaatgacactagtatcacccagccatcaacagaggtcagcttcataggcactgttgagtaatccacaagaatctctgcaagcttttcataataaacaatgacgagaacggttctttgtccaaaccatggctaagagagcctttctgcgcagatatgctttggcacctgcaactggagtttaaaagcctccagcaagctcaagtccaacatgtggcctcactcgttggcttggtttcctgagtcagaacagcagaagggactggagatgtagcacctggtgtcttaggtggccaagcagcaagcaggtgttatccctttataaattaaccatcctttggaaaggagcttgacagagaagagaggttttgtctccaaattttaaatgtggaaatagaaacagacatatggatattagaataacgtgcaaggggccaggcacagtggctcatgcctgtaatcccagcgctttgggatgctgaggtgggaggattgcttgaagccaggagttcgagaccaacctgggtaatagcaagaccccatttctacaaaaaataaaaataaaaaaattaaccaggcatagtggtgtgcccctgtagtcccagctactcaggaggctgaggtgggagcacataagtccaggagcttgaggcttcagtgagctatgagtgcacttctacactccagcctgggtgacagggctagatcctgtctctaaataacaaaaaagaatggcatgcaagaatgaccatgatagcagtgatgactatgatgagaacgatgtgctgacaatgccagtcactcatttcacagtagtgccctgatgtgggaagtacaggatggacgcttggggagcagagcacagcgtaactgaccccatggtcagtagttttcaaacatggctccctgttagactcacctggtctggccagcctacccacccccagcaccccagggagtctgatttaattgttctgggtgagaatggggcctgggcattggtactgaaactctccaggagaccttcctttgcagccagggtggagaacctctccctttgatgaaaataacccaatcaggtgggatcaggaaggaacgcaacagtcagtgccttttcagctccttcaagaataggcaaggtgaaaagcgagaaagaggtatattagtcagggttctctagagggacagaactaataggatatatatgtatatatatacacacacgcatatatatacacagacacacatatatatacacacacatatatgtatacacacacacacacacgcatatatatgtgagtttagcaagtagtattaactcccatgatcacaaggtccacaataggccatctgcaagctgaggagcaaagaagccagtccgagtcccaaaactgaactcggagtccgatgtttgagggcaggaagcatccagcagggagaaagacgtaggctggaaggctaagccagtctggcctttgcacatttttctgccagctttatatcctggctggacaggcagctgattagatggtgcccacccagattgagggtggatctgccttttccagcccactgactcaaatgttaatctcctttggcaaccctcgaagacacacccaggatcaatactttgcctccttcgatccaatcaagttgacacttggtattaaccatcacagatggtctaggagaagggaacaggagttggcgtgaggcctagaggtgagggacagatgcctactaggaggagctggggccatggtgcagggtaggagcattgcagctgagtcgggacagggtgagagtggagatggaggagcaggtaggggaggggtggggagggctttgtaggacaagctgcagggtctgcatgtcctcctgagagctaagggaagccactttggtggcatttcgcagggtagatggcatcagatacatatataagtaaataaataacatgattgtggctgcaatagggagaacggattggagagccacaaggctggaggccagaggccagggaggaggctgcgctttaacccgggtgagaggggatggtggcctgggcagagggaatggctgcagagagggattcacattatactaggagccggaactgccatttcacaaggaattgatatggaaggtgagaggaggagtcagcgtttcccaggttttcctgcctttctcaggaaacgcagtgcccctgcgactccacactcaccaccccctcacactccttgtggccctccccctgcgctaatctcctgctactccgagtccaccaaatcctaggagcagcaaggctctctcctgagaagcgatccccttccagaagatcgcagctgggtgagtcccgtgtaggtctcctctaggactatgtgccttttaatccaggagctccaccatcttcccatttacttcgagagggccatagcacacagaggtgctggcagggccaggcctctccccgcatcaccagcggtgactctacctccttccaagcttcaggatgcccctcccttccactagcccacccgccctgccttccattcatccggcgctggctctgtgggaactgtggctgaagtcatgtgtgcaaaagcatactctctaggagagtacacagaattcacaggccacactgaagccttgcttcatttgactgctcctgggaccccatcactgtgctgactgggatcctgagcctgagcccgctggtcctcgtcaggggtgatttcctgctaggtttgcttgccctgggattcacgtccctcagcttccctgcctggactaccacttcttagcgttgacatcctgctgttcctgcaaaatctctttggtttaggagatactaagccaattctgtctcagtgaaagtttgtcaggagctgagtgatctctgtcaaaagtcaatcatgactgggcagaggtagatacgaggggaggacgggaaatgacacaggggaggaagcaggctccgggaattaggccggtcagggtcacacaacaataataccttccctttgctacttgtttattctatgtgcctaaagaaggtctgcaggcacaagcctcaattctaagtcaaagcacatacagcagcacagccagtgcggtgaagtccccacggctcctcgcggctgcctgatccccatcccatggacatgcagcccatatgtgttcgctccacagagatgagctagcagagcaggacaaaatcacacctgcccccttgggcccatcattgcagcagacaccagaaatagtggtttggtattgcacaatttgtacatttcacgatgagcaaatgggattttaggtgatcttgactttcctttttcttcttttctgtgttgtttgaatgtgttatctttataatcataagaaaaacaaagctgtatgttgaagagaaatttggaaggcattgtctaaagagacgtgcagtaaaaaagaatagaataatgtcttttgcagcaacttggatggaaccggaggccattagtctaagtgaagtaactcaggaatggaaaaccaaatactacatgttctcacttataagtgggagctaagctatgcgaacataaagacaaacagaatggtacaatggacactggagactcagaactggggagaggaaagtggggtgagggttgaaaaactacatactgtatacgatatatactactcaggtgataggtgcagacctcaccagtatacaattaatccatgtagcccaaaactatttgtacccctaaggctacacaaaaagaaatgagtgagtaattttgttcaaactaaaagcttacctagttggctaagcctaacagagaaatgctactattgagcctcagagaagcttgggggccaccgcgaccacgtgtgcagcctggagaaccgagctggactgagttttgctgggagtgacagtgaaatgtaagtagaaaaaaaaatcaagttattggggaacttgcccacaagggccatggaaggactccttgggtgaacagagcgaactctaagaccctgtctctgggaggcaggtgacaccgaacacctttgaggctggtgtacttcgtctgctgcagcccactgtccagccgtcttgcctcagtgaaatgaggcaagtgaaagaaaatgctcagaaaagcatctgggcatctcaaatagatggtccaggcccttggcctcaaagattttgaatgaattctgagccttttctcttccatgtcatcctggtctgggacaggccatcgatgcctaacagcgcctgctgctcagggccatggatgtgttgacgttgctgtcatgccccatctgtggccatcagggaaccgtcagcatgctgccccgcagagccagtccatggacgcaccgtggccatgcttgtggcctaagggcatcttgggagagcggctccacagttgtttgtttcctcccccaggtgcgcatcagcagggcctgagcccggggccagcaagcatggcaggctcttggtagtgtccttagtgcacacagtcatcttccctcgtgagtctgacccatttcttttagccatagatgtttacgttggtcttttgttctttaggatgagttttctcttgtttcctgggcaacttaggcttagataggcctactccatcagcctgttctctctggggccagagatacctaggcctcaggagtgacacaattcagggatccaggtgggatgcctgccacgccatagtgtcacaaccagcatcctatgtgcagcattcagggattatctgaaaaacagaaggatccacatcatagagttgttgtaaggataaaatgtgctatcttgaagggcctcatgcaatgcagtgcacgtttcaattgcttagtacatggtagccacaccatcatacaccactcattttggatgacagcattggtggactgtgtgggtggaggtctctgagttctgagtggcacctacgccccacacctcctgccaccttctcgggctcactcaactctcatggcacttgatgaagagactgcagaatgctcaggctggctggtgcagcaggattaggtgtggcttcaactaggctgctaactttggacaatgctttgcatttgtaagtgtaagggagggaaaactttccctttagtgagatctagaagcttatatatgctcttcgtaggggacagggaaggagaatggagacaacttagggaagggtaaatgactttaactctttgtctgtggcaaagtctggctggctggcatgaacctccagtttcctctgctgtgctttcagttccctcttgcctggtggatgcctggggaggggttcatgacatctgagttcctttggaagatctgtctttgggtagaaaggaggagctcagagaaagccccttcctgcatttgctattccccaagtaccctcggtttgaagaaatcgccaagagtgatttcaatatgccatcagagtggtgtattttggggtggcatttctaaactcttttataagctacactgcatacaaatagaacatttggaaaagtcacttcctgtgactgtgcaaaaaggctttaaattgagaattgttgtctgattaatcatcacatgtgctgtgagaaatggcgtggaaccactttatgggggaaatatgtctttttagagcaaatatctgaagacagagaaatgtgaagattcaaagtgatcattctcagctgttccctggccatcagccaatattgcttttatttcctccttttactggaaacggctactcctaccttcatagaatttagaagtccagagctggaatgggcaagaacattctcaggggagcagtgaggcctgagcctggcctgagatgcatctaggatgagacagctcacagcttgtggctcaggaccactgcaagggggagggaaggtgggtgacatggacagttctataaggcaggtctttctctgaggactttccatttcctctgtccttccaccaaggctcagttgggtggtgaattaagttaactggtcattaagatgaaagagggaggaggaagttcagagcagggcttgttctccttcctggaaaatagccttgagctgtggtttgaaacaagagttgctctttaaggattagttgtattttcaaaaaccacatcagatggaaaacccagagtcacagaaactccgggcttggctttgatttggaagatgttgcaatgatctgaaccagcagtgacctcagaggtggtggccctggaaggtattgggtctcacctgagcttccacctttagttaagggcatggcctggctcctgtctacagagcagttaaacattgcaatcatggagccaaaagctcacaaaccggagtgattcatagcactgtaaggacagcttacaatcctttcctcaggcaaaggtttcgtgatgaagacactaaaagcaattgcaacaaaagcaatcctcaccaccacttgatattttctttcttttttttggatagtagccgtcctaatgttgtgaggtggtgtctcactgtatcctgctctgttttgatgagggaacatcagatatgcttcctgtgctgaacaccctctcaagagtaaaagcctcagccatcctggtggcctcccaaacctgaaggatccccagtgacctctggcctcatctctggatgatgccctgtccttcccccaggctgtttcccaagcccacctagcagccctgatgtccttctctatctgcctggtgtccccgcttcaccaggacttcatataaagtcagatcttcagaaaggacttctctgttattcctacaaaatctgcagttcctcccctgtctctgaatccctcacttggcctgcagtctttcttctctgctgtatattgagcatccggaaatgccacctggcacatagtaggtgcttagtatttgccaaatgaatgaaagaaaactatactgaactataaactaagacttctgagagttagtgacatttttagatatgaatttatagccagattcctaccaaattctaattctatttgttttcagtagattctcctgggtttcctggtatataatcatatcatctacaaataatgacagttttcctgtactcccccccttctttcccttttcatattttttagtataataaataacaggggtgatagcaacagctttatcttgcttctgaccttccatcaagtgtctctgaaattccaccatggatggtaagttaatgttggctttagatctgagggatgaattttgtcatgctgaagaagtaccatgggctcctgttttacttaggacgttttggttaaaaccaaggaagaatgaagggttaatgctcttcagcccccttcagcacctactgggtattaagctttctctttgactccttagtgtgggaattatgtggatgggtttcctacaactggaccgtccttgtgtctttaccttttaaacccagatgtgcccctgtgatgtgcagcgagcccctgtgggcagggccggccatgtcccctcgtcccttcgtcccctcgggaggcttgctgggaactgaggctggccgcggtggcaagcttcccagcgagccactcaggatggcttattgtttctgaattaaacaaacgaagaatgagattcaattagaggcagcataatgtaaaccgagatggatttatatttagcaaggcagagacatgtgggaaagaatgaaacttccttcgtttcagaattgggaagtcggctttgaagtgtggggctgggctttctggatgctgtcttcacctcccccagacgcgcccccagatgtttccctcgagatactaaacttcttgggaaagcagcagaattcagtgggcagcgagcttctgaggcttgcacgtaggagcctcgctgtctctgttaaagccacttgcaaggacgaagccacattgtccccatttcctcatttccaaatgggctgatggaacctcaaaatcctggtataatgtgattaaagaagaaaagaatagatttttttaaatgatgaagatgtcactacattgaatttacttttccaagccaaattctagagagtgccttacaggggaacaacaccctctttgttataattctgtttgggtcggctttcagcaggcaaatgagatgggaggagatttcatggatgtttcttagttgagaagagtacatgaatgtgaaacccacaatagcaatagcaaggaccagcacaggacgaagcccgccgccgactgagtgccaagtgtcatagtctgtagtttaatccccgcatctaactgtcctcatgaggtgggtgtcgtcagcctggttagggctgcttgctgcagtgtcagcagctgggcagggcagtgggtcttaaccaggaacagaaagacaggagacttgcttctttctctcccagacctgtgtctttggggttgtccataatctcttctggtttgctggggcctgtctttttgtaagaggacagcctgttccatggagatgccattcgtttgcagggagctgccctgagggaaggaatcaggagggaattactgacacagatttgtaggggtgactttattttgtacagggattttagagtttatagcaggaagaaagcaaatgcgagtccagggctctggttgcctgggtaaagaaaaattgagttgctcatgcttccagagtaagaaggaagtgttaagctggtgaccagcgtgtctcctttggggagcgtctgggagcaccctaggggagaggcagccaggcctacaaaatgtcccagaactgcctctggggaagccaaatctagagcccaccctccaggaaagaagaaaattttggatgagcagaaacaaagtcttcctggaaaataatttcaacatggaccctgcatttctttaatccctttgcctaaaggagtattatgttgctttggaaaagaagcagaaacttgttcaaatgttttttttaattaattatgtttttctaaacactaaagcatcatgactttgtgctccctcctcctcacttcccctctcttctctctgcccttttccccctctccctgctccctccccctagaaagcgtagactggggctgaactagttaatggagaccagccttcacacaggggcatctgtgggacaaagggtcttctgcaatcatggtgttttaggaagattaggaaaaatgaataacttccttgaaaaaattggttcggaggattgttttcttcgttatacctctggaaaaaattcagtgatactgcatgaagggaaaagaattaatacagctcttcctccccttttctttatttttatatccaggagtcactggaaaaatcagaccttttcccatatcacagacccagcagcagtttgggcgtgctcttgcctgtgtatagaaagcatgtcaagaccgattaaattatctaattaaaataatgaccacagagagcctgtttattttggcctgaggaaggtcagctccatgggccccttctgtcctgctgaggtccctccccagccacaagcatacacaagacctatgatgacctggcttctaataacctgctcccagtaatgtcagagtgggtcttatgccaccagtggggacaggactcactccagctgagacaaaagatcgttctttaagactctctagacaccgtctttgtatctgtatctatatccctctagacatccatctttgtatcagcatctgtatctgtatcagtatctgtactgatactgtactttgtatcaatatctgtgttgaatcagtactttgtatcagtatctgttcaccacagcaacttgaagtgtgaaaagttctggcaagggttatttttaatctacaccaatatggacaattgtttgactgagctgactacagtcttgggtgctttttgcatcatgaagataaaacctaagatccacagagcatgttgaccggtaacaagtgaagaaaacgctgccagaatattttttacacagtactaggtaatcatttggactaatttgtcatgagattattgggctgtcttgacaatgtgcaggctcagcccagtgaagggcacattcccgggaccctgtgtcacccctgaggatgcagggtattaatgagggctcattacagtcaggctagatcagggttctttggcctgcggtaagatctgggagcagaatgtaaatatgctacacatgatttaatttcaaagaagccccggaggaatgcactgagcctgtcaacactgcaaacccagtgcagggtgtaagccctgtgcagggtgtagaaatgcttctgtggctttagagacttgctgtttggtcttgcagttattgaacaaagtgctcccttttgggggtggttggttcaatatcctgtaagtccttagaatggaggccacagccttggaaagccagaatgtaaagcctcattcttattttctcacatggtcccaggagatgacggctggatgagcactcttcagaggggagcagggaggcagcggtttatgcaagggaagggcaaatgatgcagcaacaggcgagaaataaaaattgcctgcctgcctgcctgcctgcctgcctgcctgcctgccttccttccttccttccttccttccttccttccttccttccttccttcctacctccctccctctctcccttccttctctgcttcctgtcttcctcttctctttcttctttcctctttccctcctctctctctccctctgtttttccttccatccttcctcctacatttaatgagtaactgctatgagctacgagtgttagatttgtgatattcaataatattaacactgattaacatttttatgaaattctttaaagtttggcatcaaccatcttaccttgggatataggaggagaaaaggagagcaaagtgtgagtttctgtaggaaaaatttttacaaaatggtatcgagattatttttcaattttgggtgctcttcatttctttgtgtagatctagatttccacctagtataattttccttctgcctaaagaatttccttaaacattttttgtagtgcggctctgctggaggtgaattccttcagcttttgtatgtccgaaaaagtttttattttgcgttcattgttgagagattttttttttctgggtgtagatttccaggtcaacagttttttttttttcctttcaattatttaaagattgtgaactgtttcttatttatccttccagaaattttcattgcatttgaaagcgtagacttgaatctatatttgtttttgttaaagaagaatgggctgatttcagtgcccatctgtcgttctgcttcctgatgctcctttgggatctttgcctgtcgttgcacactgaactatactcgttcattttctcggatgcacggcgcacacgtgcttactgtgtctcattcaaccaatcccttactgtgggaagtttagattttttgccttctatatttttgttgttgttgtaacagtgttcttattggtatatctttatgttgtactgctcttaaaatgctttcttgtttgtgggagtggactgcattcatttttttctattctttaaaaaattttttttattttactttaagttctgggatacatgtgcagaatgtgcaggtttgttacgtaggtatacatgtgccatggtggtttgctgcacctaccaacctgtcatccaggttttaggccccacatgcattaggtatttgtcctaatgctcttggggggtggggggcaaggggagggagagcatttttttcctattctaaaatttttagtattcctccagcatcacccttcctcctcacctacccactgtctgtccctctatgatctgctatacggaaacatctacaggatgttttgtgttgagcggatgaatacatgagtgaatgaatgatggggggtcggcggggaaatgccaggcaattgcagcagctgttgctcagtgccccttcctcagaatggcaggcaagccagtgagttgagcacatggcaggaagctgcacaggccttggcgagaccagctcctgaagtgtcatctgtcatttttggttttcccattcggtggctgtcttccaaagcatgaagtcattcttagagctctggcatcaaggtgctgacccattctgtgaagccctgggttggtcttcctggggtgcttggcactaagcaaagggcagagggtgagagccagggaggcccacaatagaaacagataaagtgcttcaagaaagcccgccccatcctgcactggcaggctctgaaatgatagcctatcattttgcacacaaaaaggggaagaaaaccaacagtgcaaatggaaaaactgtccaccgtgtccagaggagggtctgatatgtcagacttgtgtgccagagagaaaccccgggaacagattgacctccaaaccaggttaccaggcctcctaccccagattcctctcctgctcagatgccagatgcaggggcaaacacctggggctgggggctgcacttctgcatcatgggcactgctccagagtctagcacctgtagactaggaagagggccacacaaggggcttggggagttaacccacatgacagctggattattcagcctcagatggacataggtgctggatggaatgccagtgctgtagtttgaatctttgatccctaaaacctcatactgagatctgatccttgatgttggaggtggacctgggggaggtgtttgggttgtgggagtggatcccccaaggcatgaatgtcttcatgcctttctcacagcgcgagagctgcttgttacaatgaacctaccccctacccacccctctcttgctccctctttcctcatgtgatccccacaggccagctcccctttgtcttccaccatgagtggaagcttcctgaggcctcaccagaagcagatgctggtgccatgcttcctgtacagcctgcagaactgtgagccaaataaacctcttttctctgtaaattacccagcctcgggtattcctttctagcaacacagttggactaagatagccaggcagtgggaagttgggagacaccaagctagccaagtggtcttgtcagtttttattagaatgcttggaatcatcttaatgtagtttgcattaagccaagtggtcttgtcagtttttattagaatgcttggaatcatcttaatgcagtttgcattaacacacacacacacacacgcacacacacacatgcacactctcaccctcttcatagagcaataatccctgactaaaagttgatgtgagcaaattaactttcttttaatttcttaacctctacaaccaagattaaatctatgcttcattgttctatttccagaaaaaaggaaagatgaccattcccttctgtgcatggaggacctagtttttggtttttctgcagttgctgcaaccacactgtttacttagatgctcagttgctaagagggaggccaagggggcaggctgttgggattcgtgattggggtgaaaagacagggagagagaaggaggaggaggaaaaggaagagagaatgatcatgccccggaggtttcagatatctgtgtgtctcaggttgcattccaaagccaacctctcccttggcataggaaagactgctttggataatctgaggctctgccgtcagccaagctgtagccagatgagctgtaactcagtttacccagaggttcttggaagttacatcgtgaggggatgggagttgaccaggtagtatgtcaatttatgtaaacaaagctgatatcctttgttaaatcaagcattctctgaacgtatttgtctgtagaacttttcgtatttttaaaatatttttttaagtaaaacatactgatatcccatggaactctgtctccagagccagactgctgaggaaagattcctatgaccacagcaggcagcaggaagtgcttttcagaatggaagcgtcactggatgtcatttggaaagtcctgtcttacccagaagatgctcaaggaagttcactcattaggcggtggctcattcttattttccacacctctgagtagtttgtagacgtaaagatgtggtcccaaatttcaaccaagtagcctcaaagatgagagtacgcagttagacatgaacatacatattccatgaacatggttgattttgcggattgctaccaataaaaagttctatcacatttacttttaaaattagatttgaagttaatttcattttgacatgatttgagatgattttatgtaacatcatctaaaaagttaagattagagtggattaaaataaacagaactgggaatactttattcactcagtcactcactcaagtttgtctaaatggatgtccagatgatcaaaaagacggcatctgtccgtgtagtctaaagtcacacagacattcgtattttctgaagatcaagaattacaaatccatacgctgtacaaattccatagaggttaaacctcacctcgtaaataggtgttgacttttaaaactgacaatcagacattccagctgcatgctgataaaactgtcattcctccctagtttttgttagaatccagtgaatactaaaaaaaagttaaaatcctgccttcatgagttactgagtgagacaatccaagtgggaggtgcggcctccacagcccacaccccagctggtccacctgcaggctgcctctgccaggcccaggctgtgtgtccatggggcaaaccgctcacctggagtccctgaggaagggagcacacaggcggcccccttcagagcctggatgtcctgggagagacacggcatttctgggagtgattaccttgtgcaggaagggacagcccactggggacagccctaagtggggaactgcctgacctgcagttgcccaaacgccatggaatcaaccagacccaggagcctcacagcccctctcttcctttaaagctccctacatacctcctccaacccatatcacacccaccctgcctagcacaggccacagaaatagctgtccccaggccacggacatgaggcagagcaggtggagacaggagagaacagaagccagggggcatctgcggaggaaatggtggggatacaaaggaaaacctcccaggtctgcagcgggagcggcagagcatcggcttttctgctgacagttgcagatgcatctctggaccaggagtgcaaagctctgagttctggtccccgctctgtcaccaagctccaaggtgatctctggctaatcactcccttctcagtgaaataatgggacagggccagataacctgcaaactggtgcctcccgcccttacccagctcccctgggagggggctccttcccggggttcctccaaatgtgacctgtgcggcaggcctgtgcttatgctcagagctacaccgtcacattgcacagggaaacctcgattctgggtgtcgttaggacacaacgaaggcctaagcatgcccgagcccctggtgactccactaggcgggcacaggagtgtctcagagatgtttccctcctgagcaccggccctcttcccgttccctgctaatctctgtgttctcactgggctgagcacctttgttcttggcatgggaatttccatgtgttgaatatgcttaaaacattttttgagaggttgcctttctaaatattttggttcttaactcgagagttttgctgcttttcagagttggtttcctttttatgtgctaaactcttgctgggagagatcagagtaaccacctgtgccggtggaatttcaagtctaccacagaggataaaagccacaatagtggctggaaagaaatgagagtgagaagtcctgtctgcaccccttccctgctctgtttttctgcacagagggcaaatgtgaaagtggaaaccataatattgccccgcagaatgaaaacatctggggtttggctcctttttcctgtctttggacaacatttattatcatcttgagatttaacacacctatttttgccaagcaaatggtgttatgatggtgagtgagatgacaagtgcagccgcagaaccctcaccggctgtctcccttcctgagcgtctctgaactgactggcccttggtgaaacttcagccaactagggcttcattcctttctctgtcagccttgcgagtcttggacatgcttttctcactgagttgtcagcgtctctgggttttctcattgtgcactgtgcacagtgccgggcacagagtgtcttcctaccatccttcttgctagggtcctctgccatttgtggaagccccctctatacctcacactgtcttctcacagggcagcctatgctgccttcctgactgtgtcctgtgatggcgtgcaggactgcaaggtcactttgcagagcgtctgttttcttatttataaaatgggaatcatatctatcttctctttctcctgaggtggaggtgaaggtcaagcacagagccctcctggcatatccagtgctctctccgttatgaggaggggtaaggagtgaggatggtgtttccgggaaagcagaggtgaggcccgctggactccaggcagctctctgctctccttgccttttgcctcaggtaaaaaaaataaataaataagtgcaatggcccagaacacagtcaccctcctcattcccccttggctaggatggaaggcattgctaacagcgggtagtggtgactggagaggacttgcagtgtcccatttgcaggagccatggggacggtgatttctgtggagtgggaggggtgagaggcatgggtgggccttgctttctgcaagattcgattcgtccgatccgcctaccttgccagctccccgcctctcacagcgagcctccggagattgggaagcggcgtttcctcacctgccagtgctcctgtactccagctccgcagaccccactccagcctcgcgccttgcatcacacacatcagagcagcatctctcaggccaagcccttccacatttctgctgcgctcctggcatgtggctaaccccgcatggcttcctacatttagtcatggataccggagatgggaagggctttaaatgccagttggtcaaggctcatttcacatatgagggaaatgagatccagagaagctgaacaacttacctgagatcacacagtttgcactgtagaattggataagaaccccgctcttcagctctcagccagcatcctcgtgctgtgtgaagtgatgggtatattggccatagctcgggatgtgctacacctggtgcatgtgcttatccttttataagctgtgctctgtgagcattgctgtaggaggcagggtggagacatgggagagggcagtgctcagaggttctgagttctagtcctgctggcaccaactggctgtgatcctgggcaaggcccactgcctctttggggcctgtttttcttgttttaaagtaaaaagtttggactgcaaggcctctttcagttttaaaagtctgaatcaaatcccaggactttgggaggccgaggcgggtggattgtttgaggtcaggagtttgagaccagcctggacaagatggtgaaaccccgtctctactaaaaatacaaaaaaattagctgggcgtggtggtgtgcacctgtagtcccagctacttgggaggctgaggcaggagagtcgcttgaacccgggaggtggaggttgcagtgagccgagatgacaccactgcactccagcctgagagacagagcgagactcggtcttaaaaaaaaagtctgaatcggtactaaatgatggacccacattgaaagaaagcctgctatttgaagatgcttgctagtgaatgccaggtctttttgaaaagcgaacactccatcagttgttgttgggatcatttcagatttttgcatgtcagtcggtctggagaggagatgatgctctgaaggtgctgcctggctctgaactgtggaagccaagagctctggtggggttggaactgaaggtccaccacatttgccccaagaagaacatccttgctggccttgctgagggagcctggcatgcatcatgcttggcaattgtcttcctgagactcccctgctgggacagcgacagggcatggggccctgaatgcatgacaacaacaactgcaggtctcctgacccttgtttgtagaggtgggtcatctctagtaccgacctccatccacctgcgaagcagggctggtcactttgttaccagccacagccctcccctggagggatctgcagtgtaaacggatcatgtgagtgctgacctttgcaaaggtccaaatgtggtcaattcagttattcataccaggcaaggaagctgccttatgaataattcaaagttgttgcaaatccacaaacctttttcacattgcctgcttgcagtaggctctccataaatgtttactgaatcactgaataaattaacatatgaatgaatattttgcaataagcttttggtatttacatttgcacatccatctgttgatgctctgaggatcagcagcagtcctcacaaaagggctcaggcatgctcccaaaacaggccagaaaagccaagtgggccatggttctctcttgctctgcaagggtggcggggaatagaaaaaaatgttcccatggctgatacagcctctagctagaagctgtgagattcctgacacacgccatgccagatttgtgtggcttaacacttttattctgcttttataaccctctcctctagctttggttaaaactactatgtggtcagcagaatggccccccaaagatgtttgggccctcacccctggaaactgtgactatgttacatcatgtgggaagaggactttgcagatatgattaaagttatggaccttacaatagagaattatcttgaattatctgggcaggcccaaccaaatcacatgtgtcctcaaaagcgaagaactctcttcacgggagtccgagagatggggctgaaggagaagtgggagggatggaaaggtgagaatgctccatgggctgttaggggcttgcagagggtggggcagtgagtccaggaatgcaggtggccccaaggagctgaaagggccctggaaccagtggagaaatggggacttccatcctgtaactataaggatgtaaattctcccaacaatataagtaagcttggaaatagaatcctccctggagcctccagaaagggacacagccctgccagcaccttgattttggcctggtgggaccctaagcaaagaacctactgagccaccccgtggctggacttctgacccacagaaactgtgacgaatatatgggtgatgttttaatttaccaacttttatagcagcatgctaagacagcaaacaaatatcactgtggctttggacacgtggcttcagctcttgggaccctgtttcttccccctgagtttgaagggttgggccacacgatctctgacacctctcccagctctcaggttctaggatttgctatcaatgaataccaacagtttttggaatcaggctttggagtcaaccaggctgggttcagattgccactttacaacttgaagctgtgctgcctttctgtgtttttcttcctaatctgtacacagggataataacactgccttacaaggtcttaacgattaaatgggatcatgtatgaaaagaaacctggctcatagtgtgtacttgataaatatcacttcctttctctatctcatttttatagtcctgccattgcaagctgggttgccccccacaaaacgcaaggaggcatctcagcaagtttcaagatttccatcctcctatagctgggacttttggctaaagctctaggaacaaggacatgactcgggactggctagagttacaaagaagctgagaagtgcacagaactgtaagaagcaggcacttttgggatttgctgtcaatctcaaaccccagcagcccagcctggggtccctgtcaggttgctcactagtggggaagacctcaggtccaggcgactgtcatccaggagcaggagctggttctttttttttggactcctaggtgttaggctggctcagttctgcagcttctgggcatcaagtaggaggttggtgtcacttattgtgacatgtgatgtagttctagacttttccaggctttccagtgtgtctgtttcatgggatttgccatctacagttcagaaagctgactgatccaaagagaaggattttgcagtgggctcttcagttttccgaagctcaggtttagcttctttcatcattctttgcgacggaccctgctgtggtgaaaatgagatgttaggtcacttatttcttcaaggacgacaggtgcctgaccacaggtgtggataacacctgatgtccccgcgggcccattgccactgctctcagccttctgctggactcacagagtttatgatgttgccaacaggcacgtcttcccctggctcctcttggaaacaactaggaccttcaacaggaacctggctaataaagaaaccacattatttcttcatgccctgggacagctctgactcatgatcaataaaccacactgtcctgtgtttggaaatggtagcagaaaaaacttcatttaaatgtaagttagggaaatatccagtcctattttagtaaagtcctgacccctaaaatggcagctatatatacattaggataatctgggtgaaattttagcctggaaaatctgagcaactttcccttaattgcgtcagttcccttttcactgggcccacagggatttaaacacaagaacaatctcagaggacagctgaattgagataaaacacagggttagcaggtactttggccgactcagagcctaggttcaaattctggctctgcaccttactagctatgtgacatttggcaagttacttcacctttttgggactcagtttccttgtctgcaggggttgctatgaagattaagggaatttaagtgggaaatatataaagcattcagaactttgcttggcaccaggcaagtgcatggtattaggttggtgcaaaactaatagctgtttttgccattactttcaatggcaaaaaaccgtgattactttcacatcaacctaatataaatattagctatcattgtggaatcttattactgtcttcatatgaccagacatcactgatcccctgagccaatcctctccatgagaatgaaccagtctgaggctaggcgtggtggctcacacctgtaatcccagcactttgggaggccgaggtgggcagatcacttgaggtcaggagtctgagaccagcctgctcaacgtggtgaaaccccgtctctactaaaaaaaaaaatacaaaaattagccagatatggtggtgggcacctatgatctcagctacttgggaggctgaggcaggagaatcacttgaacccgggaggcagaggttgcagtgagctgagatcgcaccactgcactccagcctgggcaacacagtgagaccctgtctcaaaaaaaaaaaaaaaaaaagaaaaaaaagagaacgaaccaatctgatcctatgaagcagtgagccttggatcaaccttttcacctggggtcctccttgggtacctggcactatggcccagcccctcttctcttgcagaatctttgggaactggctggcagtggaattctccaagtcaggtgaaatcattgtctctcatgtatcaaaattgctatttcggatggacaaactgttttttctaacacatctctaggactcagcttaaaaaaaattatgtcaatagctttattggctccagatcagcaaaagaaaaaagggggcagaaagctctgcctttcaacagagcaatcaaaaatgctgaacctgtcttcccctgaagacttatttatggctttcttttcagaattctttcctttggtggttagacatgcacagagtctttgaagtgggcgagacatgttttctgcatgtgtgagcagctgtttccctgcagggctggtttggaagcaggtttttcttatgacttctagtcatccactgaaaggtctgtcatgggattttgcacgggacttggtcatggtggacaaataagaggattgtagaggtgactcttcatccccactgtgaagtgatggtcttcaaatgctcctctcaggcgacaccttttgaggctctggaatgccccccagagggtatgattccaccattcctcctgtgtgctcccaccttgctcctgtatcagaagctgcatcaatatcagctatgcacatgataaatcgaaagcaaagctgcagtgcaaacatcactggggtggctttcctgtcacgcccaggatcccagcgccagcatccaagcctgactgggtgatgtgtccatcccatcgtaactgcacaatgatcgttccagtctctgcttttcttctaaaagcaaaacctacccttccacggttacgtgttcattaaatgagacaacacagaaagtaaggataggcaatgcacagaaagcactcagtaaactctcttgttatcactgtcatgatcgcatgttggtctaagcagggctttcagacaaataaaggcccgaaagactgcgtcagtcattcacccatatttcaatctctgtctcactctcctgtcttagaaaagaataaacctcctgtggttctgggtcccctgtggctaccttactatctctttccttacaaagtcagtatccaggagatttacgtcgttgacatttcctctacttcccctcaacctgtaacccccccactgtcaggctgtgcccccatcagcgctctagaccctggcttcctgccatggtcaagcccagaggcctcgtttgaggctttggatctgccgggttcagtagggtgtccagctgtgcagaaggctacagaacattccaaatgtggccgctgggcaccaaggaacggaatttttaattattttacatttaaaagcagatactttattcagttattgaaaaacctttaagtacaattggaaccacttgcatctgtgaatgtagtttttcaactgtaaattgtataaactgtaaatacagatcaagcatttctgatgaaaatctggtgtctgaattgagatgtgctataagtgtcaaatgtgataccaggtttccaagatttggttccaaaaaaagaatgtaaaatatctcgattttttatatcttcattacattttgaaatcacagcattttggccgtattgggttgaacaaaatatattattaaaatggatttcatgttttggttttctttttagggttgctgctttcaagcaacgttggtggcttgcattttatttctatcgttctgtgctgcagtgggcatttgctcctggaaattctttggcttctgagctccaggctctcctgccgcctctcccaccccaggcctttctgctttccctctgtatactggtggcctcacagccgctcctcagggctgtgcttccaagagtcctgtccttgcactttttctctgtcatatggtacatcttgctgtgagactcccctgttgctttttgcttgtgcaccaacttctaacgtctgcctgaacctttctgcagacagttgcagcacaatcctctctgacaccaaactcaacacgctccaggtcattccatccccttcctgcagaatcctcatcctctttctgattgctgtccctctgaactgtgtccaaatcattcctgctagaaactgggggcagcctagagtcctcccttactctcatgtccagcatctcaacagatacggatcccacagcttctctccagtaaatacaattcaatcagcacccctctggtctgcaccaggcatgagccacgtccccatgaccccctgtcctcatggcctcctgtccccatgacctcctttcctcatgacctcctgtccccatggcctcctttccccatgacttcctgtccccatggcccctggtcactatggcctcctgtccccatggccgctggtcaccatggcgtcctgtccccatggctgccctgtccccaaggcccccctgttcccatggccttttgtttctatggcctccctgtcccctaatcccctgtccccaccctctctccttgtcagccagtctctaggtctaggcagaggaaggtttgcaacctgacaggctcacctgcttaattttcttcagtggtgtgcatttattaggaagattgctaaatgcttcttgatatgttaggcatcctgcttgaaacctgaagagggagacactagggcacagaagcataaggtacagtcctcattttcttcctgttcctcaggacagtacaaaggccctttgtccacttctccatctcacattccctttcagtccactccaagctccctctgtgccaacaggtgtccctggcagtgagctgctccatgctgtgacccagcctcccatcctgcccaccggtcacctccacctcactcctccctggcatctatacagatcctccacccatgtagggcggcaccctctctcttctgtgcccctctgaaccacgtggcgcctctgtcacattacctggtaactgactgtccctgggtcttaccagcctggcctcaaaccacattgtattaagattaatgttcaaatcatggccagactgcatggtctcaactggggactcagctgccccggcatccctgttggctttctgagaggttggctctctgagaggctggctccagagctggggctcaggtccatgttcctctccccggacccctgagatgcctcaccctggcctctgccaggaggagtgtggcctaggagtgttgggggcattaaggggttcattgtttgcaaagaattaaaaacacaatgataaaaactaaaaccaactcgaggttcgtctgctttctagtatcaccctcctctggcaactctaaacaatggcagagagagagagcactgctccccacccccagggtggcctctcccactgcagcccctgccccctcaaagcatttgtcctagccacttatcccaccatcttatcataattgctggtctacttctctacctcacctactaaaccatattattttaagggtagaggctagatttttatatttattttctcagggcttagcataatctacaataaagaacgtattaaaaaacttattgaattaatatattaatagattttctcatttatcagaatatcataagcaggaaattctttgtcaactaatcgagtggtaagaagacagtaggaatttatttaaaataatcttgcattattctaaggttactagagtgccagccaatgttttacacttttgttttacggtataggaaagggattattgcaagcagaatgtgaatttgaagtccttcaggattctgatcaacagcaagagctttaatgaatgcattcattaatatttcttacttagcatgtgctagggcttgggctatagagtaaagtgggaaaatggacctatgtattttattgagatttcagcattgacagtagaattattctggtgaatactgaacttataagaaagtccaactaagcagatgtggaattttgcaggcatttcccaggataaagtgacatattcccctccctcctggtgaagcttcagctccattaatcatgaccacttggacacttcaatgaactcatggaaacagtcactgccatactctgaggaggtctattgatttctaggtgcctttgcaatttgtgacagagatcagacagttttcagccatctgcacagattctattcatccctctgtgtgtgtgtgtcacatgcgtgcacagaagaaaggcttgccaagtttatcaaccagagtctttaaagatcacgtgaaagtcttgttttcttttcaaggagaagcctctggtgtctggtgcctttgatctgggcatgagacggccttgcctttgtgtacagtggaggtgagtgaccatccaaattacgcagatgaacttactgaaattgtggaaggtgtagtagttaatttggtttaatgatttacagccatgcttttgaatattaaaaggtcgtttgctttgaaagtctgcctacagtttcctagatcagtggaagagcatgaatctcagtttgtcaatattgcaagtgtgttttggggcaagatttgttcactgggcaagaaataaggattattttagtcatgtacacatatctctacgaacattcataaaagttggtgtgaaataggatgcatagaacatgttaaagaagtcctatttggctttaatgtgcagacttggaccttaactcaaccctggtgtccatctttcttccgtggagtttttccttccaggctgaagctgtgatgtgagcttcagggggcctgagcaagggcccacagtcagagtgctggccctcactgtggcagatggggcgaatacttacacagtcaggcgcggcctagccacagcagtgcctttggagataagcatccataggcgatttcatcattgtgcgaacatcgcagggtgcactgacacaaacctagtgggtggagcccactacacaccgaggctgtgtggtgtggcccattgctcctacgctggaaacctgtgcagcatgagatggtactgagtactgcaggccattgtaatacagtgtttgtgtgtctacgtgtatctaaacatagaaaagctaccataaaaatatgatataaaacataaaaaatagcagtgagtggtgagtgaatgtgaaggcctaccacatgatgtacatcaggggtccccaaccccagggtcaaggaccagtaccagtccgtggtctgttaagaaccgggctgcacagcaggaggtgagtggagggcaggcattactgcctgagccccacctcctgtcagatcagctgcagcattagattctcatagaagcacaaaccctattgtgaactgtgcatgcaagggaaccaggctgtgagctccttatgaaaatctcatgcctgatgatttgagttggaacagtttcgtcctgaaatcatccccgcgctggtctgtggaaaaatgatcttccatgaaaccagtccctggtgccaaaaatgttggggactgaccgctgatgtacatgactgtagactttatatacactgtatataaagtgtatataaagtatacttgggctacactaaatttattttaaaacctttttcttcattaataaattaaacttagcttaccataacttttttactttataaactttaaattttttttaactttttgactcttgcaataatactcagcgtaaaacacaaacacattgtacagctgtataaaaatatttatatacttattctataagctcttttctatttttaatttttttttggcttttaaaagttttttgttaaaaacgaaagcacaaacccacacattagcctaggcctacacaggggcagaatcatcaatatcactgtctctaccggaaggtcttctggggcaataactttcacggagctgccgtcttctagaataacaatgtcttcttctggatactccttgaagaacctgcctgagcctactttacagctaccttttttttctttttttggtaagtagaaggagtacactctaacaataaaaagtatggtaaatacacaaactagtaacatagccatttactatcataattaagtataatgtactgtacataattgtacgtgctaggcttttatagggccagcagtgcagtaggttggtgagcaatggaccatgatatcaggacggcaatgatgttactaggcaaaaggaattttccagctccattataatcttatggcaccaccatcatctgtgcagtctgtcattggctgaaatgtctttatgcagcacgtgactgtatgtttgtgtgtgtgtgtgtgtgtacagggtagtgggtcatgtagctaacttttcatctgaggtctggtttcacataagcagcctgaggtggcttgtggccaggctggtgagtcctggtgctagtcgggtcccaaaggtactatgactgaagtctccatggggttctgttaaactgggtcaacttagctaagctgggaggatctttgccatgtcagcgttcatcacaggagatatctgagggccttggaaggggtgagtaaggagcaggtctgagcagggcaggtgctgctgccactcaagtcccaggtggcccgcctcaggccgcagcagctccagcttcccgaaggtcgtccttcagcttcggcaaatcctgcaggttgcccgcatcacaggctgatgagaggcagtgagagacgcttgttgatgtggtttggatattcatcccctctaaatctcacgttgagatgtactcccctgtgtttggaggtggggactggtgggaggtgttcgggtcgtgggggtggatccctcatggcttggtgctgtcctcaccacagtgagtgagttctctcagagatctggttgtaaaagtgtgtggtgcctctcaccactctccctctcttgctcttgctctcaccatgtgacatgcctgctcccccttcaccttctgccatgagtcaaagctcccagtggcctccttagaagccgagcagttgctggtgccatgattggcagaactgtgagccaattaaacctcttttctttataaaatacccagtcttgggtatttacttattgcaacttattgaactgcctaacacgcatgccttcttacgctgttggtcttcccacttcatgttcatcgtgctttcctgagggctggccttgctgaatcccaccgagcaccagattggaggtaccagacccacacagacacctcattccactcccatgagggaggaagggccattctctgcaatagatccctactcgacaccacttgaagtggttctgcagcctggagtgagccctggctgaaacacacttcagctgtttctgagaagcaggatggtctgctctcctctctcctagggatgaggcacaggagggcaggctctggcacaggaggctggagggcaggctctgcgatgtggggaagtaagacatagctgtggtggtctctgaaccgtgcgtgcagtaacaggaagattgtgggcacaggtctcctttgcaggattttagaaataggcaggctctgctctttctccaagagtcacattgctgtaaggcagaggaataaaaccacttctcggcagctcctgatgggacacagccatggccatggagcaaggtgatgaacgaggcagaagcgcccagctgaagccctagcgccatccacctcccactgcaagcatgttgacctttgacagctggctttatctctactgcacagtgaaggatcatattacagaaatagcaatgcctatgccacttggctgtttggatgatgaaacaacatgatttttgcttaagtgccatgtaatccacacagtgttacacacatgttatttctattcatgtggctattaaaacagttaagctttggatttgctcttgtctgtttccaagaacactgcagagggagagaaatcagtgagttgaaaatcaaaccactctcaaaacagctcaagaaagcaaccactttgtcttctactatttggtggtggtgcatgcatgcttctgtctccttcccagccaggccatgcccggatgaaactgcagcaacaggaacctgcagaaatctgcaggcagggatgacataaaatagatccgtgtgtccgcagcagagagcttctccaccttagagtcaaagaaactactttctcccaacccagtgccatgggaaaaagaatgggatttgttatttttaaatcttttaaaagatttaaaaaccaaattcaactgggatcctgcatgggaatttctactaggatatatttcttgaagacttgttgtcattgcattaccgtttcaaaacagaatagttcataaacatctcctgtgcagcattgaacccttctcattttagaggtgtcctgggaaaagtttgacatttaacagggagggctgtgatttgaagtctttaggtcagcaccccagagcatggaatttttttggtgactgtattttcagacaggtctagtaaaaatcattcttatttttaaatgtcctctgtctgtggcgggagccttgtctttcagagtaggcacagtgatgtctagctgtcaccatggtcacagtttcatccaggcatgggctggctgggaaggagacagaagcatgcatgcaccaccaccgaatagtagaagacaaagtgattgctttcttgagctgttttgagagtggtttgattttcaactcactgatgagctggtttgcaaaatgctgagagcaggggagacagacagagagcagagagagcacaggttagggtgatggctccaaaggctgtgggagagtgggattgttactgaaacaccaggggtttggtctaggtcctgttgcttgccacacagaaagccaatcactgagacaagtattgccggggaaggcagctttattcagatggtacagtcaaggagatgggagatcagtctcaaatccatctcctaaactgactaaaattaagagtttacatagcggggaagaaacgtaactacttatgggaaaacaggaattagggaggggtaaggaagaggagttagtcaacaggcagcaggtggtgggttatgcaatcatgatgggtgaggggtctggtgtctcattgtcctgatgctgtgatctggaaagtttcagttccttgaaactatctgtgagcgctgatggttgctttcctgagaaaggaactcagataagacaaatgtaactttctagttttaaaactagaaggaccaatttctatgcttattcaaaagaaaccataaacatcagttctatggaacaactgggctggtttcaggattaggggatggggccctgtgggtgctccctggaggggtgaggtcatcaggtgagggaggctgctggcacagacctatgctgtgtgtgtactccagcacccaccctctcaggacatcctgagcccaggcatggctacagctgctcctcccaacgggggtgggaccctctcctaactctggctgggggtcaggcaggtggactgatgccctcggaatgggacatggctgcagaggaagcacattttccctttcagttcagagctatccgaatggagagttcttcagggatgtcacagtcctggtaaactctgaggcaggactctaaagaccccaatattttgcttagtatcctcagtgtagctgagccctgattggttaatacaactgagccctgattggttgatacagctgagccctgattggccaaggcagctgagctcttggccaatgattggttggttcaggtgagctctggtgtcccaaagttgaacagaggtgttggttttggggacctccagagtatgtgtgtgactcctcatcagcaaatagctgcatgtctctattttatatttaggcccagtcagccactttggatccaccttcaaggactggctctttcaggttcacatttgttagcaccattttaaaaattggttcacaagctcagtgtaaggggtcaacccatggcagccactaacctttttactgtatccatagatttgcctttttcagaatgtcatatcattggaatcatatagcatgtaaccttttcagattggcttatttcacttaccaatatgcatttaagtttcctccacatcttttcatggcttgatagggcatttctttctagtgctgaataatattccattatctggctgtactacagtttatttatccattcacctactgaaggacatcttgtttgcttccaagttgtggcaataatgaataaagctgctctaaacatctgcgtacaagtttctgtgtgaacatatgttttcaactgttttgggtaaataccaaggtgcacattgctggatcgtatggtaagactgtttagtttcataagaaagcaccaagctgtcttccaaagtggctatacccttttgcattcccaccagcaatggaagacagttcttgttgctccacatccttgtcagcatttggtgttgtcgtgttctagacgttgaccattctaataggtgtgcagtgggatctcactgctgtgttaatttgcatttcctgatgacatgtgatgtggaggatgtgcttatttgccatctgcatctcttctttcatgaggtgtctcttcttgaatgtttttaactccggaaagaaaattagtacaccatgaaattcttttctttttctccaaaacaaaaaacgaccaaagtaaaaaaaaaaaaaaaaaaacaagcagaccaaaacatgacactcctttagcccagctcattatactcactcctaaatacagaacagaatatctgggaagggctgggtaggagaggtacctgggggcctgtgaacgttgttttgcccctttcctgtgaaactaaatctctcccagagcccatagggaatgaggagaggggaagaaagttctgattttggctttttgcatgggagctggacaaaatcctgccaagggccacttcatctaaggatgcttcttaaaggagaatttggttctaggactagtggccactaggaacaggttgataaggcacaggaatagaatggtcagatatggattatctcacagtcattgaggacttactacatgctcagcatgttggtaaatgcttctcattggattctcactgcaacccccacatagtaggcactgttatttctctctttcttgccacgtgggctggtacatgttgaatttagatggagcggagcctggtatttggccttgcttacagtctcctggtctaggtcgctcagacttgaacaatatgagcgaacaggttcttgtttggaaggcgtggctttaagactacccaaggcttgtggctcttaaagaatataaagtgaaatgacaagacagcatcccatgcaaggcaggcagctactacacagctgaataaattgccaggttgtatgcgtagtggaacccttgagaaaatcccatcaccatcctcacatctgataattgagtcatatttgcagagatggtagctcactttgaagtggctttgccatcaggttcctgggtggataaaattgtatcagaagatgagtcagcattcttcctctcctctagtgaaaacagaaacagcgaactcttaaatctctgttcattccttctttcccaggctgggggagaaggtggaagcttcctttagtcttaccgtgtgatgtgatctgctgtgacatctggcagtgcctgcagtaaaagaaacagctgggaatggtcatgtcctgttttctggatgatataatgcaggctagaagtctatgtccatcaactatcagtcaccgcctctgagacactgcacgtgcaactaattagctagaccaagaagtctccaaagacctggattcagaaaccaaactccccttgattacgtgggccatattcctggtggctggacttcattaaccttggctgtgttcagctatggaggcctctgatcgagtcaagatattttgctgcctagttgttgctgatttgattcaggtttttattactttacaaaggcaatgcttatccctgtgggtgataagaaaccaacaaggcccaagctgccagcattggtttcccctgcctctaaaccagcatgctctatttgggtgtttattacgggactttggactgcagatggaattgcaagtgctccctgctcagggaacttgccctcagagggagaatgcaggcctgcataaaccccaggagatccattgaggagacacctaaagcaagtccagtgatggtgtgacaggatgatgctgtgatgctcatggtgagacggtggggcaagggccccaggcaagtgagaaggcccactgaaggcctcgctttccactgctctccctcctgcttttcagcagcctcttctcagcttgcctgggtctctcttttcttctgctttttctgctgtgctctttctctaactttcctggcccgtgatttctgtgtactcttttctccttctccaggcagaacttgtggtgtgccaccctctgggaggcacaggacctgtctgatgtggctcctgtactcgggatggccagctgccctcttcccgcctgtgggcaggtccttccgcagccagccggagagggcagtctcaggccctgtcacttctttgtaactcatgatcaaacaggttctgtgaggattagggaggcacccagctttgtgttataattactaatcctttgttttcgtaacattgggagaatgtttttttgtttgtctagatggttgattctaaatagctgcagagctcgtggcagtaaggttaaatgtcactcatgactcattggtgccccgtgtgtctgcaggtgtcagtcactgctgtttgaaaagctggggtcccgcagtgctcggctgtcctcagctctggccactgtgataatgacctggtgagatttggaaattaccgatggctggtcccacccccaagtttgatttaattggtttggatgatggcctgggcatcaagattttagaaatccctcctggtgcttcttacaatgacgaaggaagccagtgctcagactctatgaaatcagcgaaggctggaggccaggaagagccaggggcccgaggcagcagcatgagttcacattcccttcagctgcactgttctctcagatggtctcacagtcttgcttccccaggagatggaaaccttactcttcctccctcatttattcactcagcaaacataggtagagcccttaataagtgtcaggcattagggagacccatggaggggacacagaggctgttttcacaagacttacagggtggcatgggaatgcagctttgtaaacaggtgatttcagcacccaccgtgagtctcaatagagaccatgaatctgcacagggcaaggaagcgctcactcagcatacgtatgttaggggcaagttatagaatggtttttagagttacaatccttatttaatggtgaagagagttgaggggtttggaccaagttgtgtgctcttggttaccaaggtgaaagagcgacaaggcgtttgttcacccgagctctatccccatatgggtttgaatctgcttctccgtcacagctaaggaagtgtcctaccatttgcattctgagaggtaagataatacctagagaatgaaagcatttccagctgctgcccccatggatctgacccttagtacccacgcgtgtgctgtggtcatggctactgaacgtgaccagcagtgtcaggatcacctgggagcttgtcgaaaatgtaaattctgaggccctcacctgagacttactaaattggaatctctgggggtgggcctggggatctgtgtctgatgaactcttgaggtgattctcatgcctgttaatgtttgagaagccccactggaggtcactgggtcagctcctgataggtggatgcaggaggttgctctgttattcccaattttccacccactttaaatccataccctttgccatgtgactctgtagttcctccgaccagaatagaagtatctgccccttttctgacagtgctgggctgacaggtggactgtgggagaaggggatagtgtcctgctgatgttgagcctagaccttaggagacattggatgtctctgcttgcccctccaggagcttccaacttctgcatggaaaaaaaaatgctgcaggtaactgctgtctctttcccctgtgccccagaatgaacgcatgtggagcagagcctcccagctgacctgtagacctatagcccagagcagaacttccctagctgacctgaagatctttaggcatgagaataaatgcatggtactgtttgccactggcatggtttgttacgcagcaatagctgactgacccagtggtagggacagggacaggttttgtaggcctagacagacaagagcagtgcccaggtgtaaggctattggcatcaggaagtcaggccagcagcctaggttcgataatcagagactctatgtagtgtggccctttaccttggcctcctgagtcctcagcagctggtcctaagctctatgcctgattctcttggtattacctgttcagatccctgggagaatttgattaacgatgccatagatcacagaagccacgttatctctcacttgaattattgcaagcaccaaataagaacaatggctactaggtgaactgatagcttaatggtttgaggaattaaacaagttggccacaataaccattccagtttctacctggtggaagactttgtcagtggagccagaaaaacgcctggagctaaggtgcttctctgaggacaggtcttggctaggtagtggctgcctctgcttttggaacgctccttcccctgtgctttcagggctggcttgttgaagcagtcaggatagggtaggctctgctgctgtaaaaaactgtgacatctcagtgattaccagaaacaaatttattccttgcttgtaccacaatccaaggtgagtcaggtatctctcttagtggctcttctccagggatgattcagagacccacgatgcttccagcttccactctgccatctgagcgttctctaatctcagctgcacagatgagagtgtggggagcatgcccctggctgtactgccctggccagggatagcatcactcctgcagagtgtgcaggaagaggactcaagcatagggtccacaaccagctttaaggcagcaaagaaaggtgtttttctgtgtttctgggaagaggaagcagtgtggggaacagaacattgcttctgttattcctgtatttaaggtaacattgtttctcttctatgggttcactagacatttatttcaccctttagctcttagagggcaacattatttccaataaggtaagtaataaccaccaacggactctagagataaataaaaactgggcttgatgaaggagtaaggagtggaacccgacagttccttgcaatgacaaaccctggagggaagaacactgagtgagaaatatttgtggataggcacagatttgtatgcaaatcattgagattatttttgctaaatatattagaattttgagttaaatggcaggaaagaggcccagtgtggctcatctgtgttagcagtttgcattgccttatgagtctcttcatcttggcatttcagattgttacatgttgaaggagacttagaaattattaaatcgaaatcatttcatgctaaatgcagggaaccgaggtgcagtgtagtggaatacagcgagcctgcaaagcagggtgccaggtcgcctgaccaccagtccagtgccctcttcaccacctgctccgtgcaaggagggttcctgccaatcatgtcccagggcattggtgaacctgagggcttgtgctttcttctgattttgagtcattggatgcaagcaaacctaagagaagtgggtggtggtgtttgatgcctcctcacggcaccccccaacaactgccacattagaaaactcttctgagcctgccgtgtggccctggtggaagcaacatgaaagcttctaataacagccttggggaaaagcactctgccaaggtgtctttgtgtcctttttggggcgtttgatgagcttcctttgctttacatatagctttccaggaagaggcagatgcgcttctcaccacagagctattaataccccaagccaagcacttaaaggaaaacatcaaccaagtgtttagccatgtagttgggcgggggttgaaagagacagaaggagggagagagcaagaacaggtgcaggggttcatttcaatgaaggaaaatacaacaggaaaggaatccagtgctgctctgttgtgtttctaaagttcacatgaattgaattttctgtggcccaccaggtgatattaaacgtagctttcttggattagataataattaggaagcgtgttggtaataattagcagcaatttgccaatcactaggggccagctggccctagctccctgctgctaattcggcagagtggccgtccgctctaagcaggcctttaaggcaaggtgctgttttaggaagacagtcggggacaattccacagtggaaaatctctggttctatgagcatccaaggttgaaataagtgtaggcttatttcatttgggaagcttaattaaaaagtaaaaaatgtcctttcttctacaactggaaactttaacatgaggaagaaaaggggcttctttcttcttccctcttcttcttccttctccttcttttaaagatagtaaggaaaactaccactgtttcaggtttggaagctagtctttggttttatactaaatgaaacctgttaacagagcagatgagtgtattttaaatggaatctgttaaaccaacatagtagacacatcccttattttcgcatgtgtttgggtttgaagtccatgaagctgggcaggggggtgatgtgcgaacattgggagaggtcaggaattcagctgctggggaagaggctgagccacaggaagcttagatacacgtgtgtgtactgtgagctggagccagtaagggttcagagctggggagtggggactgcaaagaatgcagatggggcctggcccaccctccagggtacatccacatttctgagaaacgctatgccaggggaacattaagagtgagggggctatgttttcagaggttacttcagaccttgggtatgtggggaggtgaggcaacaaagactgagagatgtcagccaatgaaaaagtgtagtcacctctcagaaatacaccccctgcagtattttagagacaatgtagaatagatgcccaaagtaaagataatcccagagtggagtatattcaggctgagcaataccatgtagagcggggtccccacccccggggccaggaactggtaccactccgtggcctgttaggaaccaagccgcacagcaggaggtgagcagcaggagagcaagcaaagcttcatctgcattcatagctgctcccctccccgcctcgaattaccgcctgagctctgcctcctgtcagatcagtggcagcactggattctcataggagcacgaaccctatggtgaactgcgaatgcaagggttctaggttgcgcacttttttttgctcttttttttgagacagtcttgctctgtcacccaggctggaatgcagtggcacgatcttggcttactgcaacctccacctcctgggttcaagtgattctcctgcctcagcctcctgagtagcggggattatgggcacctgccaccacgctcggctatttttttttattattgtttttagtgaagacggggtttcactatgttagccaggctggtttcgaactcttgacctcaaatgatccatctgcctcggcctcccaaagtgttaggattacaggaatgagccaccgtgcccagcctagttgcatacttcttataagaatctaatgcctgatgatctgtcactgtctcccatcattcccagatgggaccctctagttgcaggaaaacaagctcagggctcccactggttctacattatggtgagttgtataattatttcattatatatttcaatgtaataataatagaaataaagtgcacaataaatgtaatgtgcttgaatcatcccgaaaccatccccctcgccccctggtccgtggaaaaattgtcttccatgaaatcagtcccttgtgccaaaaaagttaaggaccactggcttatgggacctaactctgactatgtgaatgcaatgtcctgtgtttttttaaaagtaatttgtatttattttagttgaaaaataaagattatatctatttattgtgtatgacattttaaaatatgcatacattgtgggatggctaaattgagctaattaacatgtgcattatctcacataatcttttttgtggtgagaacacttaaaatctactctcagcaatttttaagaatacaataccaagttattaactatagtcaccatgttatacaacagattgcttgaactcattcctcctgtctaactgaaactttgtttcatttcgccaacatctccctctcttacttcctactcaatgccctgtgtttttttaaggcaagaagtttgggtagtgactgtatattctgcaaaatccctgtggactagacaggtgaaggccagtgttgattgggagcctgagattaggagggcagagacctccgttccccttggatccaggttggatggaaagtatcagatgtcaggcagatcactggtttacagccagcaaaattacctggggagctttagaaagtactgatgcttggattccattccagcaaaactaaatcagcatcccagcaggtgggaggggggcccaagcatcatgggtcttaagagagctgcccagtaaggcttgagaaatacccttagagggctcagggggatggacagtgtctcccccgccccaaattcatgttcacccagaacctgaggacgtggccctatttggaatagggtccgtgaagatgtgatgaaagacaagttcatactggagcagagtgggccccaagtccagggactgctgtccttctaagaagagcagaggacacagatgtgcacggagaagaaggccgagtgaggatggagggcgaagggtgggagctacggggccacaagccacaggacagctgaggccactgcaggctgaagaggtgaggaaggatctctcccaagccttcaacaggagcagggccctgcagacaccttgatttcaacttccagcctccagaaaggtgagagatgtcatttctgtggtttcaagccagcctgttgtggcatttattacagcagccctgggaaactgaaatgagcagtttccaatccctgactatggcctttcccgaaggggcaaacagatttgtatccaaagaccctcatcaagggctcccattctcacaggaggggagcagagttcaggcaacagagactgagattcccacagtgaggggcactccaggggtggtaaggctgcatggatgtctaatgaaagatgtcctagtggaaagcggagacttagggtctagtggtgtgaggagtgtgactaccgttggcctctcagagcagacacaggcacaggcataactgctcacgtgcagtgaggctgaccccgcagagtacggctctgcactgcgtaacaacatttcagtcagtgatggactaagtatacgacagtggtcccataagattataatggagctgaaaaccttctatcacctggtgatgtagccgtcatgacatcatagcacaatgcattgctcacatgtttctggtgatgcactgccagtcattcaaaagtcgagcacatgcaattatgtacagcacataatgtttggtaataatcataagcggctatgttacaggcttgtgtatttattatatgacacttttaatcattattttagagtgtactccttctacttaccaaaaaaaaaaaaaaaaaaaaggaactgtaaagcagcctcaggcgggtccttcaggaggtatccagaagaaggcattgtgatcccaggagatgacagctccatgcatgtcactgccctgaagaccttccagtgggacaagatgtggaagaggaagacagtgatactgataatacttctaaaaatagaaaaaagcttatagaataacaatgtacagaaagaaaatattttttgtatagctataaaatgtgtgttttaagctaaatgtaatgagtcaaacagttaaaaatatttaaaagttgataaagtaaaaagttacagtaagctgtttcatttatttttgaagaaaaaaatttaaaaaataaatgcagtgtagcctaagtctccagtgtttctaaagtctatagtagtgtacagtaatgtcctagctttcccattcactcaccactcactcactgactcacccaggactgccagccctgtaaactcctgtaaacagatggtcatatagttgctcgtggggtcaccttgtccttgctctgcctgactctgtgcccagctcatcttcctggctgctggctcagctggcctcccatggtctcctccttgctctgttttttgctgacccccttggtgaatggatgttcctggattcctagaagctctggcaagttctgacttgtaagttccctatataagtgtatcataattttgtcttttataccacatttttattgtatctttcctatatttagatctgtttagatacacaaatactcatgattgtgttataagtgtccatagtattcaagacagtaacatgctgcccaggtttgtagcctaggagcaatgccataccatatagcttagggtgttgtaggctgtaccatctagatttgtgtaagggcactctgtttgcacaatgatgaaatcacctaaagacgcatttctcagaatgtatccctgttgttaagcaatgcatgactgtatatactgtaaatttccctcttacccttctccaaaggcatgtggcagctatttgtcaggtaactgtgcattgaggaaaggggaagtgatgagactttgagggtttattggactcaaaaggctactatgatacattagccagagtaggaaatttttggggtctggagtcatggagttttgactcaggtctatttcatcttgtgccgagtgtgtctctgaacccatcctatgcttacatccctggttttggaatatgtaactggaatagacataacaactgtcagactcccctcattgtttccctgacccatggaatgacccaaggtctactataatgggaaggaccaagtggaagattctagagcttcctctacctcttcaaatattaatccaaaagcattatacccttcctggaaggactgcagagattagtgccactcttaagaacttgaaagtcagcgttagagaatcctaccatatttccatttaccttgtctatttggcctgtgcagaaggtagatggatttttaggaacaaacgtggattactgtaaacttaatctggtggtgaatccaattgcagatgtgtattgtttgcacatcacctccagctggtttgcagctctcaagcttgcagattttccccactcttcacctgttggtaaagatcaccagaagcagtttgtcttcagttggcagggctagcaatacaccttcactgaactaactcagggttatagcagctctctggtcctctgtcataatctaattcacagggatcttgactgcctctccattccatgggacatcgtgctggtccgctccattgaagataattgatgatatcatgctgattggacctggtgagcaggaagtgagttgaggggaaactgacctagacactttgaaaagacatatgtgtaacagagggtagaaataagtcccacaaaaattcaggggccttccatctcagtgaaaaggtataggagtctcatgttccaaggcattttaaaaatcccttccaaggtgaaaggtgagtttctgtatctagaatcttctctagaaagaaatgcaaaatctaatgggccttttttggatcttaaagacaatatatacctcatttggtcatgtcactctgagccatttgttgaagcacccagaaaggctgccagttttgagtgggtctcctaacaaaagaaggctccgcaagagacgtctctgcaagttgctccaccactttggccatgtgacacaacagattcgatgacacttgatgcgtccctgactggttgctatactgtgacattggcaggctcctatcaatgaagcatacagcaagtctttaggagaagcatagctctaccattctctgcaaataactattttttcttttgataaatagcttctgacttgttacagggccgtagaaaagactgaacacttgaccataggccaccacatgatccaaactgtccagcaagaatcaggtgttttctgaccaaccaacctgtaaaatcaggtgtgcacagcagcactgcatcctcagggggaggtaatatattcaatgttggccttgagcagatcctgaaagcacatgtaagttacccaaacaagtggctcagagtctcccggcccctagttccgctcagttgccttctctctctcaacttccgctatggctcattagaaattccctatggccagttgactgggaaggaagaacttcagtctcagtttacatgattttgcatggtatggccacccaaagatagataaagcaacactgagactttgcaccctatttcagggagagacttagtgtgtcttttgttgtgtgagagatagttgcaccatgttaggtaaaaacattattttatgatcgtatttatttggaaatgaaaaatggtcaaaagaggtatatatggatggttttgcactgtgtccacttgatcaagctggaactgtgtttcccagtatccttgcataagtctgagttagagttggccagaggagaaagttgcatggccttggagaggtagaaggtgggaagcaggcatcaccccatgaagatgaggtgagatgtgatgagagacagaggcagacactggtagtggctaggttgttctctctgttcctcatggacagatggtcatatagttgctcgtggggtcaccttgtccttgctctgcctgactgtgcccagctcatcttcttggctgctgacccagctggcctcctatggtctcctccttgctctgttttttgctgacccctttggtgaatggatgtccctggattcctagaagctctggcaagttctgcctcatgcaccagtgcaggtcatcatcagagagtccaattagtgactccctcttctgggcccttaattccctagcttccccacaattgtatacatgtttatgcctattataaataggaattgttggtaccctaagcctgggagggaaggaaaaactcaccaaatccctgaagaaaggatggcaaatctgggccattctcctgggatacggcaggaatgaggtgactgacttctcacctttctcacctctgccacctggcaggtatatgtcaggggaagccccaacggtcaggtttcagcctcagtgatcgaaaccttcaatgttcactgttaggagacaggcaaattatgaacccaactagagccaccaggcagcacaagccctacagcacacccgtcttggtcttctaagtttgaggagagttacatagtaacttcagtaataaaatcttgtagagtggagagaggaagcttccagaacatgttagtgggctgatagttaaggtataagcccatctcaagcagcccatattaactaaaactttagcaataagctcctgacacgtgagtcaaggagccttagggaaaacttttgaaacatgtgtctggtgtctctaaatgccatgagatagccatttttgatgttttaccccctaaatgtatgctcatggagctgagaggatagtaaaagcagacttctaagatgaatttagagatatttcttgtctggactataaaccaaaacccaaaaaacccaggatcctatggggctcaccaaaggtttctagaaggtcttagttgtggagatccttaaacatggaacttttagaaaattagtaatcaccattaaatttggctttgtagggcaaggggactttttaacatttaaatcctagagagcttagttactaaacagagcagggtgcttttaggatactgatgaaatccagacatctatgttcaaatctggttgttcctaagacagccactattctattgattgattgattaagagtgtcttgttctgttgtccaggctggagtgcagtggtgtgatcatggctcactgcagcctcaacctcccaggctcaagtggtcctcccacctcagcctctgagttgctgggattacaggcgcatgccactgtgcctgactaattaattattattattttttgagacagggtctccctatgctgcctaggttggtcttgaactcctggtctcaagtgacccttctgcctctgcttcctaaagtgttgggattataggtgtgagccaccacatctggcctactctctttagatcaaagtttccttgtctgcaaaacaaataggttgggctatgacagaggatagactgatctcccaagtcagttctcatcaactggaggtttacaggactcagggaactggcgctgagaatggaggtcaccttggccagtcaagagcttgtaagttagtgagagccaactttttatatggggatcttgaatgttcagatttaccacttaccactttttgactaagcttcaatttcctcaatgataaaacggaaatactgtggtagctacatgacatggtgtttgtaggggctaactcagatgtccaacaaatacttaaaaccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctaaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaatacttaaaaccagttctggcaaactggttttcagcaaaagttaaccatgagagtgagcacttcggagcccttccctctgcttcctgaatgcctctctgtgctctgatgccagcaccaactgggtatgttcgagaaattcttggattccaaaagtggagattttagttctgcaggtccagtttgggaacaaggatctgtatttctaggaagctcctcagataataatgatatggagtcttgttttgaaatccttgcactaggaaacacacaggtatacacccatttgcacacgcacacaatctcacatacagctacttagtgaagctattaaaatcgagttgcactttgaagaagatattcctcagttttgcaatgaaatgagtttatgtatttatttacatccctgcctcttctaaaggatttcataaagaatgctttatgccagcaatccccaaactttttggcaccagagaccagtttcgtggaaggcaatttttccatgggccgggggcaggtgaagatggtttcaggatgaacccattccacctcagatcatcaggcattaggtagattctcataaggattgtgaaacctagaaccctctcatgtgcatttcacaatagggtatgggctcctgtgagaatctaatgccgtggccgatctgacaggaggtggagctcaggtggtaatgctctctcatctgcccctcacctcctgctgtgtagcctggtgccggtctgctgcccggtggttggggactgctgatttacaccacactgagtaagcctcaatcagaggttcctcatctgcctttcaaaaatactccaggcaagactcacttggaggaatgcagtggatttgtctggcatctggacattccttccatgtcatggcacacatctggttttttgagatgagcgggacatttcctgtccagtttccctccagatgtttgaggatgtgaagatgcagcccaaggggtgagcaatctatccagcttcaatgacctgttaaaattcagtcctcagcagggtcctcactagactcattatgttcaccatctgtatgtgcctaggtcttttcacacagacaccctgcacagcagtccttcggttgcatagagcttccatcagatagacagcggactttttcattccctccactttgcacatgcatgccttggaggcccagcacaaagtgagggattggtgcacatttgcaaatggacgtcttggagcagacagatgggtggatggttatctggcttctacagaatccaagttaagctaataccattcagattccttcccagcctatgctgtgctttctcaaggttgctgaaattgaattcaaaagccaagaacatatgctggccaggctcaaagagcaattgccgattgcaaacacatggcttagcaatgcataaggtgctatggggtgacatttggtgttgttgattaagtgggatagtcacaagaactgtcattcaaatccattgcccttgcacgtagcacgtgttaaaaaattttgttttttaaacaaagcactaagtaaaaaacaaaacagaaaaattctgatgcaaatgctttatggttctgaagatggaaactaaattttggatttgatttttacagatgtggatggaaaacgccacataaaacaagaggctctgcagttaggatttcttgcagccttgagtgcgatttatgaaacaaggaagattaagattcatggccataaagaattcagtatagagatatcttcaggtcacaaagcaaaacagattttttgtgtgtgtgcagcagtcatgtctgttccatcagtcaaggatgcctgtgggtaccaggctagggccaaatcaaatgcttgccctcagaaaattgccaccaggcttagaaaggataaagaaagggaggtggtcacagagagcatacaagcctcctccaaaattccaggttggaaacactttgttattggcaagtgtccaggttcctcagctttgccaagagactctttgaaggcaggactagtcttagccgcatgggttaggatcgtgtgggtgacattttaacaaagaaggtggtcctgtcacatggaggaaatgaaaatgtgctgtgcagaaatccctgaaaaggctgctggccgtgaggcaatcccattgttctgcagtttttgatttgggcatttgctattaaaataacaccggcagtaagaggcagtgtggctctgcagagtgccctggcacagctctcagagctgcgtccttggccttactgcggtttcccccgtgggactttggtgattcattcgtcccccgggtctccatttctcctcctctcctttggcagattccctttacaagagaaattgtttgcagagctcccatctctcccctctcccttcattccttctgtgaccattgttcctgctgaataaatggatttgcatatattcattgacagtttcctaaaccctttcgaaatgcaatgatagctggctgggagcgcatttcgaggaggggtggatgggtcatgctgcatatgtagattgtgacacaaaccatgacacaggggtagatcttttccctgtttccaccttccattgtgtagctttttctggggtgcagcctggctggagcttgagggtcggaacattctgaattcattctgaatccagcctggctggagttgaggatcagaacattctgaattcagaaataaataaagtaaatcccatcaaaagaaatcagtggtgctgctaccacatcctgagcgctgggctcagtgactgctgtctgaagcagtgtgtgctgagtgcgccctcatgccagaagatggtctgagacagcaaagcttcaggctgtgcctggagtcacttcccggaaagcctctgtgcccacaggtgggctcaagaccagggagtcccgcagcaaagaccacagcttgatgccacttcaccaagagtttcccaaacctatctgctgtcccaaaatactcactttttggaacatgtatatatgaagaacatctttggggacctcaggactgatgggaaggtgcccaccgccagttagcagctcacactgagcaggttcagggagaaatgtgtgtggaggtaggactgggggcattctcaggggcctttcaattctgggtagatccccccttgcaatgtttctcaaccatttcttcatgatcacctccctaagaagaaaaatcaaatgaaatttaaattctccctaatgagagaagtgaaatacggagaaacataattttgttgaataacatcgcgttttagagagccacaaaccattataacatccaaattgttttctccctcaagaatcaatttttgctgcccttggaggcaacattgcctccctgccccccatagagagtccatggtttaggggtccatgtcagctttcaaataactttgcctgatttagaggggatagggctggccttctggagaagccactttcttctgctgtgatggattggggagtggggtgttggggagtggggtgtcagagggtggaggagacaaggatttggctctactgtctcagattccagggaagttaggagtgagtttcccagattcagataaaaggaaacagatacaaggactattgatgtatggaggtgataatgggtcaggttttaagagcaagagttcaaatctggctggacacagtggctcacacctgtaatcctactgctttggaggctgaggcaggtggatcgcttgagctcaagagattaagacctgcctgggcaacatggcgagaacccttctctacaaaaaaattaaaaaataaaaaattatccaggtgtggtgatgtgtgtctgtggtcacagctgctcaagaggctgaggtgggaggactgctttagcccaagaggttgaggctgcagtgagccatgatcacgctactccagcctgggcaacaggacaagacccttcctcaaaaaaaaaaaaaaaaaaaagaagagttcaaagatcttagctttgccagttgttggctgaataaccagataaccttaggcaagttacttaacctccttgagcttctctttctcagtctgtaagttggggatcatatgagctcactggatttttgtgagcaatttctcttcatgatatgagaagtgcttaagacagtgcctgaggcctaattagctttcatttgaattcacatttattcttttaaaaataatagcattattaatctgatacctaatttcaggaatgtcaggtgataatctgccagtacttcttaagtaacacttttatattttgtcttgagagaggtagtggtgtccatttttcctttaagaaatgattaatggtaggatttcttggctcttgtggttggtaaccaggagagctaaatttgggctagcatttttcggcagccttcaaattaggtcactttgttagccatggacttattttaaatcttggctctattgtttaaaagctatgtgagctagtgcaagttactagacatcattgtgcctcagtgtcctcttcagtaaaatggggacaatcttgcagcattgtgagtcaacaaggtaatgcacataaattacatcatgatttagtttttggtcctgctacagtggacattgttggttgcctcctgagcctcagtgcccaccacccttcctcttcctaacaaaacttgttttattcaggcatcaaccctacgcaagacaatccaagtgcctttcttcatctctaacattagtccaagccaaatggcacatggcgctcccctgggtgacctgagttggcttgtgcacagggaagtgtgtcatctcctactagatgtgaacaagaatacatgaggccccaggtgctacaggtggacatctgaagccgcaggcagccacagggcctcctgcttaggatgcagccagcaggcgagtggaacacagagataggaaagctggcatttctttttttctttttttgggatttaactttatggatcaatcatttattttatttcatttatttattttttttttaatttttttgagacagagtcacactctgtcacccagtttggagtgcggtggtgcaatcttggctcactgcaacctgggttcaagcaattctcctgcctcagtctcccaagtagctgggattacaggcgcacaccactacacccagcgaatttttgtacttttagtagagacagggtttcaccatgttgtccaggctggtctcaaactcctggcctcaagtgatccacctgccttggcctcccaaagtgtagggattacaggcgtgagccacagtgcccagctgactcaatcacttattgatcaatattcttgatcaaaacaaatagccaattagcatttttttaatttattttttattttaatttttttcaacttttattttagattcaagggtacatgtgcagatttgttatatgggtatgttttgtgatgctgaggtttggggtacgattgatcagttacccagatactgagaatagtacttgatacttagtttttcaacccttccccacctcccaccctctcacctctagtagtccccagagtctgctgttgccatctttttgttcatgagtacccattgtttagcacccacttatgtgagaacatgcggtatatggttttctgtgttaattcacttaggattatggcctccagctgcatccatgttgctcaaaggacatgactttattcttctttatggctgcatagtatttcatggtgtatatgtactgctttttctttatccagtccactgttgatgggcacctaggttgattccatgtctttgctattgtgactggtgcagtgatgaacatgtaagtgcatgtgtctttttggtagaacaatttgttttcttttgggtatatacctagtaatgggattgctgggttgaacggtgattctgttttaaagttctctgggaaatctccaaactgcttttcacagtgtctgaactaatttacagttgcaccaacaatgtataagctttacctattctcctcagcctcatcagcatctgttactttttgtctttttaataatagccattctgactggtgtgagatggtatctcattgtggttttgacttgcatttttctgatgattagtgatgtggagcattttatcatatgtttgttggccacttgtgtgtcttcttttgagaagtgtctgttcatgtcttttgcccattttttaacaggattatttgttttttttttttctctttctttttgcttgttgatttgtttaagttccttatagattctggatattagaccttcattggatgcatagtgtgtgaatattttatcccactacgtagattgtctatttactctgttgatagtttcttctgctatgcagaagagatttagtttaatcaggtcccacttgtcaattgttgtctttgttgcaattgcttttgaggacttagttataagcccaaagtccataatggtgtttttaaggttttttttttctaggattgttatagtttgaggtcttatatctttaatccatctgaaattaatttttgtatatggtgaaagttagttaggggtccagttttgttcttctgcagatgactagccagttattcaagcattattgatgacatagggaatcctttccctattgcttatttttaagctttagtcaaaaatcagatggctgtaggtgcacggttttatttgtgggttctctattctgttccattgacgtatgtgtctatgatatgggttggctctgtgtccccaaccaaatctcatgttgaattgtaatcccccagtgttggaggtggggcctggtgggagatgattggattatgggggtggtttctaacgggttaaaactgcccccctagtgctgtctcgtgatagatttctcatgagatctgacagtttaaaagtgcatggcacttcctcctttgttgtctctctctcctgtcaccatgtgaatatgtgcttgcttccgctttgccttctgccatgattgtaagtttcccaggcctccccagccatgcctcctgtacagcctatggaactgtgaatcaattaaacctcttttctttataaactacccagtagcaggtagctttttataccaatgtgagaatggactaatacagtctgttttcgtaccagtgccatgctgttttggttactgtagccttatagtacagcctgaagtcaggtaatgtgacacttccagcttttttttctttttgcttaggattgctctggctatttgggctaatttttggtttcatattaattttagaatagtttttctagttctgtgaaaaatgacattggtagtttggtagaaatagtgttgaatctatacattgctttgggcagtatggccattttaatgatactgagtcttctaatccatgagcatgaaatattttttcatttgtttgtgtcatctgttattttttttagcagttttatacttctccttgtagagatttttcacctccttggttagatgcattcctaggtatattattattttttatggctattgtaaatgggattacattatgaatttgactctcagaacgttattggtgtatagaaatactgccgattttcgtacactgattttgtatcctaaaactatactgaagttatttatcagttccaggagccttttggtggagtcttcagggttttctaagtgtagaatcatatcatccatgaaagaagagaacttgatctcttcttttcctatttaaatgccttttatttctttctcttgcttgattgctctagctagcacttccagtactatgttgaataggagtggtgagagtgggcatccttgtcttattttagttctcaaggggatggttccagcttttgcccattcagtataatgttgcctgtgggtttgtcagagatgactcttattattttgaagtatgttcctttgatggctagtttcttgaggatttttatcaggaagggatgttggattttatcaaaagctatttttgcatctattgagaagatcacatggtttttaattctgtttattgatttcaaaaatgatttatttaatcacatttattgattcatatatgttgaaacactcttgaatctccagaataaagactactttattatgggaaattaactttttgatgtgctgttggattcagttttctagtattttgttgaggattttgcatttgtgttcattaggatattggcctgtagttctctgcttttttttgttttttttttttttttgggttttttgccaggttttggtatcaaggtgatactggcttcacagaatgagttagagaggagtccctcttcctcaatttttaagaatagtttcagctcttctttgtacatctggtagaatttggctgtgaatccatctggtccagggctttttttgttaataggtttttaattagtgctttaatttcagaactcaatagtggtctgtttagggtttcaatttcttcctgattcagtcttgcaggttgtatgtttccaagaatttatccatttcttctagattttttagtttgtgtgcatagaggtgttcatgacagtctctggggatcttttgtatttctgtgggattagtgaaaacttgcgtttctgatggcattgctgtaccacttaccaaccagccctgaagtgtgtccttcctcttggcttctggttatgtgtcagaataagaaataaaatctttctctattgtgtaaggaggtttgaatgcagattaaaagtatctcaactaatacgtctatttttccagaatcattgcaactttgggttttattttatccatcccttcctctgttcatttattcaacttttttctttaatgagccccatgcaaaaagcactatatcacatactgtggaaatacaaatgaatcaaattctcagcccatatgcttaagaaactgaaatctattatggaaaaaagaaagtccaaaaagtggcttgaagataaatgcatggctcagatgacaagggagtagctgatgagatgtgcatcttcctgtgggcagggaggtcacggatgagaccacggaccatgagtaaggcagggcccatgtgggacacgtccctggggcatgaccatgtggcaagcactgggggccatgagtggccagtttggttggagaagtctcataagaaagacaagggcagagtctagagaatcttgaatgccaacccaaagaatctgaaataaaaaaaaaagtggaatagaaaattcactgaatagttttgagctgcagtgtgatgggatgaaatggtatgttaggaaaagtaaattgatgaaatcgtggcactgaggcactggcttggagattctattttgtgctcccctcatccctttcgaaatgatgatgacacatggagcacacagattccactgcttctctctgctctaactctcgtgtttccagttgtgctttcctattatatcagtaagagcctctctttgaactaaagcaggctataaggatgtaaggatttgcattttgttatgcaggagatttctttgcattttacatcatgtttctccacctcaagcgtgtggagttgagttcatcatacttctcagctcatggtaactcagggttgaaggggaattctgagtttaatatcctattgtaagccagcccataatgcagacggctgatctctttatcatattgtctcctgtttgttattatccatattcttttttttttgagacggagtctcgctctgtcccccaggctggagtgcagtggcgccatctcggctcactgcaagctccgcctcctgggttcatgccattcttctgcctcagcctcccgagtagctgggactacaggcacctgccaccacgccctgctaattttttgtatttttagtagagatggggtttcaccgtgttagccaggatggtctctatctcctgacctcgtgatccgcctgcctcggcctcccaaagtgctgggattacaggcgtcagccaccgtgccctgcctatccatattcttaaacattgaagatagtccaatagtatttagagcattggttctgcctttagctagaggaggaaaagaaacttccactcaagtcagaacaagttctactcttccagatcatcaaattctgaaaggccgagtctcttataatcaccttctagtgtatttagtgatccaatttattgcattcattataaatgtggacagctctacagttatatcattagtgttcattcaatctaaaatagctcaagaccattctgcaacaaattagcaattataaatatggccttctaccaatcttaatagagacagtcctatattcaacagtagtaggtagttgcaatagttcctttccacgcgtttacttattttctcatttacttattcagtaaacatttgagtgtctaccatgtgttgtgtctgttaccaaatgtggagatgactcccaatccaccacttcattatttccccttcactgttcaaatgtggacgtgttgtccactgctcccctgagatgggtctaagacctcttggtcctcccaattgtcagatttaatagaatccttcactggtaccatgactcaggggtggtggttactgttgatcaccctctccttgaagtgcttcccttgactattatgagattttgctggctcttctaagtctctgatgacttatctcttaaatgttggaattcttcagaaatctggtcttagtcttcttttcttctaaagccttgctcaccgttgggcaatctcaccctaaatgctgatgcctccgacatctttctttctagcctgacctttctctggagattggaccactgtgctcaccctctccctggggccacctctcagtctctctcctaaaataagtcatcatctttccatacaactcctcttcccatattttctgtcctggttaattgtgattgtcaacaaagtcagtggatccattgtggggttggtccatgagataaatgctgcaggaaatatttccatcttcctttccacatcgtcacttgtgtcagtattgattgtgaggtggataagagtggcgttaaaatgaaccactaatggttggtcttttctaatatactagaataatttttcctgaaaaaaagtaagtccctttagcttgaactcttgagtgaaagagagagaagtggagttaagaccgctttgttggcgggccacgggagtattctgcatctttgaatgacttctggcctgggtgtcaaggtagaggagagttttggaaccagttacgttttggcctatacctgggagtttgtcagtcttggattcaatgtagtcagaatatagaggtggtagagcgtcaggagagctcctgcccccatggtctcatctctgggtccctcaggacatcctttccacatggcttcaggctgtgcagagctgcacaaggtgggctctgcctttgcacaaactcttgtctctgctggaagtactcattcactcatcttttttttttcttttttttgagacagggtcttactctgtcacccaggctggagtgcagtggtgcaatcgtggctcactgcaacctcaaacgcccagattcaagcaatcctcccactgcagcctcccaagaacctgggactgcaggtgtgtgacacagtattcggctagtttttttacatttattttttgtagagacaagatctcacaaaatgttgcccagattggcctcgaattcctgggctcaagctatcctcctgcctcagcctcctaaagtgctgggattataggtgtgagccaccatgcccagcttcattcatcagatataaagaaaaggaatgacccaggaattccactcctagacttataccccaaatgattgaaatcagggacttgaacaccaatgttcatcactattcacaatagccaaaagagggaagcaacccagtgtgtccattaacacatgagcagaaaaacacaatgcggcatgtgcatacaatggaacgttattcagccataaaaaggaatgaaaacaggaaacatgctacagcatggatgaaccttgaagacactatgctaggtgaaataagccagacacaaaaggataagtattgtataatttcatttatatagaatatctggaatagtcaaattcatggagtcagaaagtacatgagaggttgtcaggtgcctggggtggagacagaggagtaggcagttattgctaaatggttacagagattctatttggggtggtgaaaagttttgaaagcagagagtagtgatggttgcacaaccttatgaatgtaattgatgctgctgaattagacacttagacatgattaaaatggcaaaatttatgttacatatatttcactgaaataaaaaactataaatggagggataacatttaccatgacggatattagtgtacttgtagacctatgtgcatggaatttctgggccaggaaccatgcttgatttaactgtgtgtccttgaagttctgcacattggaaaggcaaacaaggagggttttggagctggtcttgcacagccaagcaatgagaagcattggtttcttatcctgtaaaagagaactttcatttttagtatgctaaaattcagctgcagagttggtcaggccccttttttgctctaaaaatctggcattttgtgatgttctagggtagaaggagcagagagggctgaaatctgggtacagtgttttctggagacaagacttgaactcacctggaggctggcatggtttgttgagggcacaaatgcagctggacttgggaaagtgagctcgggtcttgctggagaggactgggttctcagctcagcgctgccagttggagaggcagggacccgtcctggagacagtggctgacccatgcacccagaaaacctgactttctcttctcatgcgactgaactcttcctggacagcctgcgggaggcacacgtgacctgcagaggcaccagccttgtggcttcagggctgggcaggcgctgcccctcggggattgtaattatgttgatcagaactgtcttttccctgggggaaggagggcccttctttttcttcttcatttttccttaaaagaaataaaagacaaaaacaaaaaggactcctcttcatttccttcaacgtgctatggcatcttcggaactagggacttgaaacctaaagctgatcctaatttctgatggatagaatgtgcgtttggggttcttttccacatcaaattaaatctgtcttggactgatttcctggaagtgtttttcattagtataatagtcctcagctgagagatcacaggatcagatactacagaaggggaaatgcaaactggggatcatcaagtccatcctccatggagacagagacactcagtggctgcttttggggggactttgctaacgaaaaactgttccttctctgggcgtattcctagggcaggggcatggggcctggtgagccacctactttagtagttaaaacctttattcttttgtttattgaaactataagcaagaaagaaattgggttcaaccaaccaaccaaccaaccaatcaaccaatcaaccaatcaaccatccaaccaatgaagttcgtcatgcacccaccagctgccaatccttcagtggtgccaggaatatcatgattaatcaacaaagtcttaagacagcgaagttcccaggaggagccttcagacactgagacaaagctccctcagtatttaatgactctcttcctggtctcaaatgtgtccttctgtgtaatgcatatgtccaccctgtgcctcacctacagagggttcctgaatgatggaggaaatccttctgaaactcttttctcccccacttctctgatatatgacttgtttactgcaggctgttaacagccttgagagtgtctttaatcctcagccagggtctttaaatataatacatcaataacaggtaattattcactttgaactctttgctcctttcccccataccctgcggggcgagacttgcaacttttaagcactgtaacagattcttcctatcaaagtgtcaaaactcataaggcccatgtcaaggaatttgtttgcttactttaatctgccttccctcctccctcctttcccttctctcactgcaggctttgtggattactgtacggagggctagttttcatccttgtgtgttttctttaagccagcaccaccttggaccctgaagcattcgcccccacacacgcaaccttgtggccctgaagagttgcatgcagttgagtttgttgctcctggcctgtcacgttattcctgttttgaatgtgtgcaggaacatcctgtcaaattcaaaacttccttttgccccaaaccaatctttgatctgggaggcctggacacagctggctcagagcagctcatgttgtgtgtgctggtgcctgccctggtgcctgccctgggagccctgtcccaagcatcttggagcaacaggggtgtgtttgtcctgttggctggggtggtgatggatggcccagtttgccattggtccagccctgttcagaagacagctttgtctccagggagctctcccgaggttcttgggctctgtctgtggctgtggatttatctctccataggaagccacttgcaactcttccacatgtttctctctccagcaagttggaagagccaaatgattgcactaactttattgctaaattgttgcataaagtggtgcaagtctggtttcctgttcataagaaatctttattgcctgcccaagtctcccttgtatgtgtgaaggggttttcaggacactcgctgaagtgctgcatgatacaaatgctgttcactcagaaagagaaggtttgggtgtgcggaagagagggtcaaagagtactgtccgtatttcctacctcgggctctcctgaggcaatgaaatcaatggtgaaccaggaactctttctagatttaaggattttgccaggtttaactgaagggaaacattaaaattgttgcctgatattgaaaaagtgacccacatttccatacccaaataatcaaagcggataatttggttctgtgatgttcttcaggtaattttcttaattgctaatgatataaattcactttgaacatagaactaacaagatctaacaggatgttctggagtctcgctggggaatagtggctaacgaagttgaaacttttgctcttaaatttaatttcatccttgaccttgccagtgacctttggcctattgcttccccttttgatatgtttccccacggttatgatggttatacaatatcaaaggggccttcacgtgtcatcaagaacttatatgatgagcaatgtgtttatattgaagagcattgaagaattcagacactgtctgtacaggatgtcaacatatccttcattttaatcgatgtgttaaaaaatcagtgtttggatagcatgatggtcaatgaactagtgggatgactgtatttttcttttatccaacagttgttgtggccacataagatggtgcctaaatgctctacatacataattaataatggtatgaaaagcaagggcaccacggagcgctaaccttcatggagggtttgtttgcccatgaatgcagctcagcagggagggtgcactcagctctgtgaagagaggagtcagatttaaagctccctctgttttggaaccttgggcatgcagaggagcatctggtagagaagacatccagcattcctgttcctctgctttgtgattctttctctcactcctattgcagcctgattacaggttaggcttccgcagactgctctggccagccaggggctggaagatggggagtggcaggaggggtagtggatcacgtttattacaggcccaggggtattgggatatttctttccttcggttaatcttctgcagctttgttagcagcttagggaactgtaggatgcttttcatcaccacattggcttcccacaactggcaagctttctaggtggggaactgtcagaaacgtggaattcaccagcatgatttcctgaaggagtatgaatggtagctgtaaatattgattgattgttagtttacagtgtcaaaatgagttgtcacatgcttccacaaccccaccatggtgccttccatcaaacagatagtttatgtttttaatcatcagaactaatctgttaatataaacagaagacagcagattttttcaataaaaatagaataaaagggataactgattgttttagaaataatggttttaatgaatctaactagaaataagtaggtatacatatttaaaaaagaaccgacatagtttacatacattaggaagagttgtatgatagtacacacaaaaaagcagaaagagctggggccagctccatacatacaaaggagcctaagcaaattatagacaacccctcaaattataaacatggggttattaacactctacacatttctagaacttagaccatgagatcaatgttctgggtgggtcagaattgtgttcaattttttggtgcctcaattttagggagacatgaaatcaagagcaccaagaaaagacaagatgatgagggggtcttaaaaccatctcaattaaggaatagctaacgggttttatctggagaagaccgggggaatatgagatgttggccttcaaagagttaaaatactcttgcagaaaagggagtagattgctttcccgggagaatggctaatatttcaggagaagaaaattcctttcaatgtaagaaatatctgtctcagactacagctttccaactttggagtggaagttgctgttaggtagtgagctcctgtgcactggacactttatgaatgtaggggtgctggggaagaattattcacatattaaaagggagttcagataaaattatatgaaagcccctttctttgaagccaggtgtgggctggctgcccgggccttcccttctaccttctaccttttgctagaagattcccagcaaacctgctcctcttgttcatagtattatcatgaagattagaagagtgttaaagactaaattttaaaagacagtaaaatcatgactctcacacaatcataaaatgaacatgtgccaaggattttatttaactcgattaatgaggaagtcactcgatattacaactggctcaaaagagaactcaagatccacacatctatagtcagataaagaaggactgctcaacatggtgaaaccttgtctctgctaaaaatacaaaaattagccaggcatggtggtgggcacctgtaatcccagcttctcgggaagctgaggcaggagaattgcttgaacccaggaggcggaggttgcagtgagtggagatggcgccactgcactccagcctgggtgacagagcgagattccatcccagaaaaagaaaaaaaaaaaaaaaaaaaggaggacgaaatgaacttacacatcttacatatgcaatggaggcaaaattggtcagtttctacagtgtgatagtcagttgcattccactggacacaatttgcatttctacagacaggagtaagttgcatcactcccagtttgctacaagttaactttcacctctacagagttgtaaaacactctagtcaaagtggaggagcatacccctgaggcatctctaggattccattgaaaagaccgccagtgatcttttttgtccagttcgaaactgtccacatttttccctacatgaagtaacctctcacatagaggttttccccaaagttcctgacaaatgatgtgtgctcagtaaacatgatttattgttgatcatcgttgtgattcttacccaagtgtcctggggaagatgccggtggctgatatgaggtattctttgaccaaggtcaggatcaccattttttctctttcctttggaaatattatacacacatcaggctacctgctttttcctatctttcatctcccacagacaaatgcatttaatgttaaaaaaatctttgtttctaacgtgcatataaaatcctcctttttcttgttctcttccaattctctttcagtttcttattgtaggaaaatgtctctatgcttcaaatttctagttaagcttaagaaaaattctagtgatcttcctttcttaaggaaagaacaattgtaagttttaactaaatttataaatgatgaagtttagattcggtcatttcagcaaacaaaagctaaataaccattgttttgagttactgaatactcaaacattgacacaggaataatacaagttgaaaaaatatattttaacttacattagatatataaatgcaagttaaatattcacacaggtatgccttgccattcttatatgagccctgttgtccatggttctgagttacttttggatttgggggcagtgttgtttctcgtaaccatggtccacaggtgacccgtgtccagctttctcagaaactcagacccaggttacgaggaggcagcagaagagaatggtgggcattgcacagaaaccattgccactgaaagattgctaggaagaaattcagacagtgtttcatataatccaatatcaagtcatcaagaaagaaactacggttgaccataatggaaagatcacattgctaaaaaaaagtaaattgtttgtctatcaagtgaaacaagtctgtgcaagtgttgactaggccgtgggttctctgggtgttggggcagacaccagtggggatggcaggacatggtgttgacagctgacttgtgccagaggactcactgctatgatttcttgtgttgataagagtctgcttttcattgttctagaacaatggaattcagacttatattttgtaagttttgtagccattttttgcgcttttgaaagttttatcctatttctgataattacacatgacttttccgtgtctgtgaagctgcaggaaagcacataccggctcccctcaggccctacctgtcactaggtttctgaccaatctcatcgtgtacacgggcacagccagaatccccccctcccccagtgactttatggatatattgggaagatcctagaaatatctgcagaatcattataaacacctcttatactgtttaaaatgcaagatgaggaacattccttctatacctaacttgtggagagtttttatcaggaaaggatgttgaatttggtcaaatgctttttttccattttgagataattatatgatgctcttcattctgttaatatggtgaatcacatttatgaatctgtgtatgttgaaacatccttgcatcccaaggataaatgctacttaatcacagtaaatgatccctttagtgtgctgttgaatttggcttgctagtattttgtggaggatttttacatttacatttgtagaaatatccaacatctttacacgataaaaactttcaacaaattaggtagagaagaaatatctctcaacactgtagaggtcacacaggacaagcctacagctaacctcacactcaagattgaaaagctgaaagcttttcttctaagatcaggaataagacaaaaacatccactcttgtcattgctactcaacagggtattggaagtctaagtcagaacaaataggcaagaaaaggaaataaaaggcacccaggtagaaaagaaagaagttaaattctctgtttgctgatgacataaccttatatacagaaaatcctgaagactccaccaaaaaactgttagaaccaataaatgaatttagcaacattgtaggataaaaatcaacataaagaaataagtagcggccgggcgtggtggctcacacctgtaatcccagcactttgggaggccgaggcgggtggatcatgaggtcaggagatcgagaccatcctggctaacatggtgaaaccccatctctactaaaaatactaaaaattagctgggcgtggtggcgggcgcctgtagtcccagctactcaggaggctgaggcaggagaatggtgtgaacccaggaggcggagcttgcagtgagctgagatgatgccactgtactccagcctgggtgacagtgagactccatttcaaaaaaaaaaaaagaaataagtagcatttctatacactgacaatgaactatcagaaaaagaaattaagaaaacaattcaatttacaatagcataaaaaggagcaaatttaaacaagtgaaagatctgtatattgagaatgataaaacattgttaaaaaaattgaagaacatgcaaataagtggaaaagtatcccatgttcatggattggaagaattaatattgttaaaatgttcatagtacccatagttcttatgggtatccacatgaacccaaaatgtttatagtacctatctgtggacttaacataatccctgtcaaaattccaatgccattctttaaataaatagaaatagaaaaaaaatcctaaacttcataggtaaccataaaagaccctgaatagccaaagaaatcttgaacaaaaagaataatgctggaggcatcacactccatcaatttctgaatatattacaaagctatagtaaccaaaacagcatggtactggcataaaaacagatgcattgaccaatggaacagggtagaaagaccagaaataaacccacacatttatcgtcaattgattttagacaaagatgccaaaaacaaacaatggggaaaggacagtcttatcaacaaatgatgctgggaaaactggatttccacatgcagaagactggagttggacccctatcttacaccatatacaaaaaaaaaaaatcaactcaaaatggattaaagacttaaatgtaatacctaaaatggtaaaattactagaagaaaacatagaggaaaagctccgtgacattggtctgagcaataatttcttggatataacccccaaagcctagacaagaaaagcaaaaatagatcaatgggattacattcaactaaaatgtttctgaacagaaaaggaaacaattaacagtgtgaagagacaacccatgccttgagggaatacatttgcatatctgagaggagtgtaatgtctaagatatataaagaacttaactcagtactaagaaagcaaataacaatgattaaaagtgggcaaaggacccaaacagacatttttctaaagaggacatacaaatagtcagcagatatataaatactttcaacatcactaattatcagggaaatacaaactagaaccacaagaagatatcacatgttacaacggctattgagggtgcagagaaaaaggaaaccttagatacagttgttgggaatgtaaattagtgtagccattatggaaaacagtatggggttcctaaaacactaaaaatagaattaccatctgacctatcaatcctacttttgggtatatatgcaaaggatctgaaatcagtgtctcaaagagatctacacttccatgttcattgcagcatgcgatggtttggatgtttgacacaactaagcctcatgttgaaatctaatccccagtgttggaggtggggcctcctgggagggatttgggtcatgggagtgcatccctcatgaatagattaatgctcttccaaaatgtgagttctcactctatttgttcccacaggagctggttgttgaaccagtcttcctgctcccactgcaccctgccttgctgcctctctctccatgtgatctctgcatgctcagcttccctttgctttctgccgagtgcaagcagcctgaggccctcaccaggagccaagccgtgctggcaccatgcttcttgtacagcttgcagaatggtgagccaagtgaacctcttttccttgtaaattacccagcttcaggtattcctttatagcaacactaaatggactcagatacagcattaatcacaatagccaagatattgaatcaacctgtgttcatcaacagatggctggataaagccataaaaaagaaggaaattatttcatttgagacttggaagacatcaggctaaataaataaattaagtgtggagagataaatactgcatgacatcacttatatgtggaatctaaaacagtcaaactcacagaagcagagagcagaagggcgagtggaaggtggacagggaaagcagagatgttggtcagagagtacaaagttttagttagaatggggaatatgttttagtgatccattgcacagcatggggactgcagtcaataataatgtatatttcaaaattgctaacatgctagattttaaatagtctcaccataaataaatatgtgaggcaatggatatgttaattggcctgatttaatcattctacaatatatacatataacatcacactgcatcccgtatgtacaattattatgtcactttaaaataaaataaataaaaacaaaaaaacgcaagttgattaaactcttcaataacttcgttttggacttatgtatcatttgagaatattttagtaatatttacatgttgaaaacttcccctaaacattttcaatcaaaaacttgcacataaaatttcccaggttcatgtgtaaacatgcaccattgctacatgtgtgtcacagaagggtccactgatggaagagtctgtgttactgtactctcagtgactgggtgtgtgtttggcttggggtttattttgtatcaccccctcactccactcaagggcatataagaggtcgcaggattaacttctgggtgtggatggaggccaacgtaaaggctgctctacctatacatcaggggactgcagggctttattaggtttacccagacctctttcagagagatgatgtgttcacacatgtggagcagacactgagtgccaaaaatacttccagagtgctttgcaactttgctatctcctaaataattgtagacatctatgcattcttcagtaaactgtgtttatgtactgttccatggcagtgaaatctctttcaatatcttggtagcctcagcaccctctgtcccatgtgcttctcgtgtgaccccggctgtggtctgcagagctgagcccgtggtatttgggtcacataactgtttctgtgccaacgcacgttttctttcacattgctattaactgtgcagtaaagaagggagattggctggtgaaagtgtcctgggtccttcaaggattactcagatttcacagtgcctgtaatctgagctccctacactgagtggtttagtggttatggtcagatgtctgctttatcctaacctgtcagctgaacaatcatgtttgggtgtgtgtgtttgaacagtgctataattggtacgaggggttcagaaacgccctggggatgccctgacatcggatgggcacgtgcagccggtatcacagcctgccatgccatcagctccgtacttgacattcaggcctggtgatcacccctgatcccccagcttgagtccccaccactcagtttacccacaggaggaaactgagagctacagcttaggtgagaagctgccactttcttgtctgacacagccatagctatcataggatggtgaaaaattggtgttcacattaacaagagaggcctgatagaagaggcagagttgttttgaagttgagggtcgcagctcttttaccccttaggccagggagctagggagggaccagagagtggtatttgtaaggcctccaattccttttatttaagaagtgtgtgcacacacacttttgctgtagcgatttataagcacacttacgtctcagtcagtcaccgtgcttattaaagacataaatattttacctcttagcaaagacgaaaatagttttcacagatttcctggcaggcaacaacacaacctagccaacccttttcatctgtagatttcaacctaataaagtattgatctagggaacagaacttgtttctacgtcccattcctgaaaagtagaaaaccagattgaccagggctagggggagggtttgcctctacctgaggatattctgaattttatggatgctttgttgagcaatgttgaaactgaaagcgctgatggaataaaagacgtcaaactctctaaggcttgaggatgcattatagaaaagaaaaccgcctttcttgcaggtttcctgattactcatcttaattaggtattgccctgaatgacaaaacttcctctggctcctacgccccttaaccattttaattctacaaccaaacccacaatcacagctctccttgcatggcagaggccttaggctcggggtgggaatctggccacgtctgaatgcagactgtagaggtgcagatacggccctactgaaggagcaaggctgggcacagaggttaggggaggccgacttgtccctgggcacgttaagaaagacagttcctcagtcatctgggacttggtagaaaagggagaaaggaaaggagactttttcaaagaacaagataataatcatggtcagccactgtgttagcacttcttatatgttttctccttaattccagccatgcctgtgcagtggtcgcttctttcttttgctgtgtgactgcggcctggtaggctcacagaggcttggccatctgcttgtccatcgccccctgcccagcttgctggcctgcggctcctctcactccacagccaccaacgctccaccatcctgcacggacaggattctctttctctacccttcgctgggaggccgttgcttcatctcctctctggctgctcaatccaaatctgtatctcccttctctttccagacatcactgacgcagggcccagtaagccagagcttttttttttttttttttttttgagatggagtctcactcttttgcccaggctggagcgcagtggcacaatatcagctcactgaaactcaggtttcaagcaattctcctgcctcagtctcccaagtagctgagattacaagggcccaccacaacacccagctaatttttgtatttttagtagagacaggatttcaccatgttagccaggctggtcttgaacttctgacctcaagtgatccgcccccctcggcctcccagaagtgttgggattacaggcgtgagccaccctgcccggctgagccggagctttattactgatttgcagatcatgcggaaggcggtgaggctgcaggcttgcatagcacatggcttattagctggtcgattcacagctctgcaacctccctttgctgcttttgccaacccacatctagcctcccatgtctggctcagctctcttccattttgccttttgctgcttccttaatcaaccccctgcccgcttcacaactcttccctccttggttgtagaaagtcctcctgctctaactgcccccacccctaaagccagggcctaggtcgccataactgaggagccctgcatttcctctgctccaccaggcgtcttcctacttgctggtctcaggcatcctcaacaggataacttcctgcagcaacacatttcactgagtggcaaaggccaggtcgcccagcaagccactggggaggaaggcaggacatgtgtggccccagagcctcagtctgtgacctggagaacagccaatttggttttagggaatcaggttgtcctgttgtctgggccacatcaggcctggccagccagagatccaaaacaaacctgatgccgctcacagctcagcggcctgaggtcattcactcactattcctttaggaaacaaatgccagcaagtggtgtaagaataccaatgccattgcaggctctgccaacaggtacaatcattattgttatttttctaatccatgcctgttgcaattcaatcaaattaatgcttcatttattagaaaatgtgatttttgcaacacaaatagggtagggctgccccaaaagtcccagtcttttgccactgacccctgcactttcctcagcctgggaccgatctgctgccccaggaccctgccttggcctgggcattggcaacacagaaactggctcctcacagatcaaactgaaaagaggagactggggagtgcctgggacggtggaattcctgaatgtctgttgcctaggaaagaaaattcaatgccagttagcttgttgctcacacagattctgagaaagactcagactttcagagattctgcctcttgcgatatcatattagacttactaactaaaaacaaacattgtgcttaaatggaagagcaacatccagacagaaaagtgcacagataatatgtgtactgcctgatgatttcttacagactcaacacttccatgtaaccagctcccagatcaagaaacagaaccttccaggagcctcctggtgtccccttaatcactacccctcctcccaaggtaaccacaagtttgagttctactatcatagatccgtttgttctgtttttaaatgttatataaatggaaccatacagtgtgtgttcgtgtctggtgtcctttgctcagtatcctgtttgtgtgattcctgtgtgttgttgaggttcagcaaggttgctgctgattatggaagttctttcattttcatttcatttcattatttatttataaagagttccatcatgtgatatactgtagacaccattttatccattctataattaatgggcattttgattgctctctattttggaatattatgagtaaagttgctgtgagcatgtctgtggtgcacacgtgtccatatttctgttgactgtatacctaggagggcagttgcttggttgtgaggtaggtgtatggccacctttggtatatactgttaaacagctcttagagagtttataccaatatatatgttctccagggtatgagaactctgtttgtgccacatccttgccaatacttgatgttgtcttttaaattttagctattaggtggtgtgtgaaccctcacttattccatcgtgctttaatttgagatttccttgatgactaatataactgagcactttttataggtctgttgaccattttggatatcctttttatgtaaagtgcctgtttagattttgcccattaagaaactgtactgtcttactttttcttacaagaattctttctatactctggttttgagggtcctttgtcagatagatgtatgacaaaaagcttctcccattctatggcttggctcattccttactgaaacattgttaaggaagtggtaaaattattattttctattagataaataattatgaggtgttattctttgtctctagaaatggtttttgccttaaagtgtctgatattagtatagctagaccatcttttcttgggttattttgcatgctatgttttttcccatcctttcaaacttcctttacttttatatttaaggtatggctctagtaagcatcagttattttcttctactacagtctgataacctttgtcttttaattgcaatatgcatttacatttagtgtaattactaaagtttatgattgtattgttttctcattgtattggtttctcattctcaaaggaatatgtctatattccttttcccttctttttgtgcttgtttttcaggttagttattttaaaaattcatccctccctcctattagtttgttagttataccttctttttactgttattttagtggttatcatagaaatagtatgtttccttgactctcttaagtcaaataaaattaattcttttactgctttctgaatgaagggaccttagaagactttaacttcacttccttccctccttttgtgctattgctacatgtgctttaattttagtatatttagaaccctccaggacatggtaactgtatgggatagtcagcattcagttctattcacccacatactcgcttctctttgttctctcctgcacctcgtgttcctgcctggggttctttctttgtccctgaaggatgcacttgtgcttctggaaggctctggtcatctgaacccagccaggagttgggactattcaagggtgaggctgggcttctgtcctgtgagggctggtccatctctggttcactcattcctcggggagccttcaggattctcatgagaacctgaactatttggactatttgtcagggcctcttctttttgctgagccccaaactccaaatcttgccccgctaccgttgtgagtctgcagaaagctccgctctttagctctttagctagatcatcttttctttggttattttgctcctcagccactgccctggttttgggattctgtcccatggcgaacaatggcctccaagcccagggttcctcattgttggcttccctcttcttctggacaggtaaatcctccttgttctgggggctcgtagtgtccttcaagcagggtttttatatatacgatttgcccaagatcacatagtggactttgggcagagccaaggctagaacctgggaccctgccgcctggtccaggctcttccttgaggccatgttttctgcatcacctctgaggctggctttgtaggattgagggaggggagggcagatcctcaacagggatgaaaagtagatgtggaggcagcaggaagagaagctgcagtgctgcaagactcctggtagctccaggccacagggactggtcctgtcctgaagccccagtctcagcctgagagaccttgctctgccaagtgactggctggccagcagctgctgacccctcacagctggctgagcctttgcaatgatggccaaactaaaagccagttgtagagcaatgtgaccttctcttagggtattctcacatccactttctactaagggtaccggaccatggcaatatgatcatgcacagcctcttattacatatggacctcccagggaggaaatgacatgtcatgaatatcgagtgagtgtgtttgcacgagcaatcccgaattccacaggccagccagatcccactctgtggctgctcatgttactcagggtgagggtctgagcctcatcccgggacagacactcaggaccctgttgtgtgcgtcacctcccatcctcctgggccacacacacacacccttagtcgtgtccttgacatgaagattatttgccagattaacttcttttggagaaagggaaatgagggctcttcacctctgggcgatgccatctctcttttcactctctctccatccttatgagtttctttgactcccagtacaagctgcttctttgcttccacagtgcagcttccaagaatctctttttggagtcagtttgaatcattatccacgtcttcctacattactacttggagagccaggtgctgaagtgcacatgttggcatcagagagagcaggttttactctgccagtgagtggctgtgtgaacatgagccactggtctacctctacaggcctcagttttctcatctgttaaatgaggatatgacaggaatttaggcttatttgaatatggaatgagataactgcaaaggacttatcacagtgtggttggtggtagtattattagctttattataggcttgttaccatagatatgaactgtgttaaatactatgttatctaactatgttaaaaatctatgttaccgtagattgaaactacgttagctactacagtgaccatggaaatgaatcttttctctttagatttttgcaagcacatgcaaaggtgcttttagactgtctgccctcaccttctaacctacccagaacttatgaaaacattagcctgggctgccttcaagcctcctctcccaaaaccactaccagaaagcctgttcatgatcttccccgttggaaacattcttggtaactccaggacaggatcacacgcacccttgaatgctgcagcacttactttccgtgccatcactgggagctgacaagctgtcctgagtcactggttaacagtttatgtgtatgccctagtacgtgaagataccataaacttatagcaagcagttaggggccatagatatatggttttatattctccaacagggaatttccctgtaatttggtggctctaaatcagcatgagactgatttagagcagaggctctgtagtaaaacaggtctggagtcaaatcttgtctctgattgttatcgtgcctttgggaaagtagagataatggttcctgcttctcaggaattcagtgatgattaaacaatgttttagcacaggcttggctcataacaagttcccaataaatagcagctatagttaataactatttgttgactaattaattgcattaataaattaataggaacatctataattttggacatctcccttagcacaccttaaacgtcagctttgcattcatcaaacacctaagcgagcatgtgtttagctgcatgcggttcaagaacaccctgattctgctctgcagctctcatgttcattaagcaaatgcaggggaattagcaaggcacacttattaaaaacaggctggtctagaggagcctctcatgtttaatacattacagacccagtgaactgtaaaaataaatgaaggcctgcaattctgttgtttttgaagctcttaatttttttttcctctttgaacctctgggggaggaaatatgttttgaaaccatgggatgtaataaacatgacagcatcttcttaaagattcatctataacctgcactcatccggactgtatcgcaggagtgttttcttgcttttccaataagatgatcccctgaaagagaagtaatgacagtaataaatagctttaattgtcaaatgcatcttagatgatattcatgcttagaaatggaacattctagctgctagaatggaaacctcccaggggtttgatggtagatgtggggtttgtagttatagaatggagttgggtgggaactcttggtcagctgctcccaaccgtttccaagcaaggtccctccgctggcctctggtacagtggtctcaagtagtcagtcacttcacttccagggacaagctgcacaagatagctttgcaatgctgaaatgttcccaggcaggggtcacatttccaagacttgataaagatgaaatgcgtttggtaatgcttccctttccccatctgcctccctggttcccacatttctttgcctttctcaagtgaaggttaggatgcaggaatatcccagagaccaccgagggggctgcacccgctcttcttccctcttagtggatgttctggcttccggaactcagcaccctgggccctgctctctgagtttcacattcttggccccacggtgcgaaggtacttctgggttggccattttaactttggttaatcctcagcctgcctgtgtctccccaccaccagcccccagaaagcctcatttcaacatagcctgtgagataggcttcctatcaaatttgatgaatacatttgctgctctcatgcttcaggtattacgggcctcctctctcccctttgggcttcctaatctcttccacttttgcccagttcatggagtccacttaacaacacagcagctgactatgggacaatgttagaatcctccagcatatgcacattcccctggaaattgggaaagggggtgatatgaaggggagattcctcatttcctctggccaagcgtcattcctgccttggtgacgcagacacttcctccagctgggttcctgatctcctctgcattctccttttgggtggctcccttcctactctaggcctgcagccttgagggaactttatccctccctggtccatcccattcaacctagtctagtccagccattccaaaccacatgctggccagcactgggagctgcccctgcgcttgctctctgtcctcaggagctccattaactgatgtagtaatttgttattatacatttcacatgttttaatttcaggaacccggaaagctaaagctaagcacaaaaaatgaaaataaaaccacctttaatcatagagattgcaccttgatagttttaaacaagggtaggtatgtatgtagtacagatacccacacatttggattcggatgttctgattggatgttaattacatgttgcctgcataatttcctcttgcttttttcttgagagttccgtctgcattacgagtctggacacattctcaacccttttgagtctgcaattaagtggttggcagctgtaagtaatattagccactacttttaatggaaaaaaaccgcagtcacttttgcaccaacctagtatgacttgatctctgtggccctcatgaaactgagtccacattaggtacctaataagaaggtctgggttgtttacttttttttggtcctggggatgtaaccccacacaagaggctccccttctctcccagcctggcttgtgagagtcatcccgagctctgaagataaagggttaaccagagcacccgcgtcaaagggctttcaaaacgcagccatggcaggggcctccaagcctcttgcagtcactggaagccttatctgtgagagcaatcatgagggagagtccgttttatgtgctacaaaggcgctgctttcttctcttcgtctgactggagctcttgagatggagggaaactgttggccacagttctgaaaactgcagataaaggctttgatttgttaattaaatttttactatctgcatttgatatctcagccaaattgtatccgctgcaggaacaacaagaaagtctctcacttcaaaggggcgcccacttggtgacctgtaattacggaatttactgcggggtgaagcgctgtctggggcacacctgccgccctagcgcccccacgctgcccctcaataacagccccttgtccaggcagatttcgagcagccccggctccccgcactcgcgcaagggcggggtctggaggagccgcgcagggcagccgcgcagggcagtcccgcaggctgggccgcccacacctgtccccggggcgcgctgtcctctgcccggcagctgctgccgccccgcccgctccgccgcggcccccacacgctctgcaacgcgtccttggcaacctgaaagaatcggccttcttgtcctctctcctcatagatgtctcggtgaaaaatggcttctttaatgaaaaagttaaaaggccggagccacgctgggtgaggtcacctgctggctccaggcagcgtgagctgggccagactctcccgctgcggcgcaggggccaccccaccctctgccctttcactccccctggggcagggcattattaaaggatgtttagaggtcccctatgtagggctgctgccctgggaggggcgcattccagagtcagcgctgaccatttttttgcatgaatggaatcaaaatctgctagctgtctgaaggactccattcctctggtttgatataagcggagtggggtttgagaagcctgaacaattctgcaggactttctggtagattggttccaacgcaggctttgctttgaccagtttttcttattgtctttcatctttaattttaaaattcaattttagtactattgttttaaattaaaaaaaaaactgtcaagccatttaggaaaggtgtaaagtatattccaactggcgaaaaagtacaaaatttaatttaaaaaagcattttggatccacacaattttcatatgagatggggatgtattttctcagatgaaaggtctggttgtttcagctctgggggtccccctgatgactggtgtgttggtctgcatacagtggggattcatccccggaagaggaagtggggggaaagaaacacttgctagtgagcttatgccgcatcccagggtacggtctcacatgagacacggaatgttgagctgttgatctggttttgaaaacataggcttgctgattatctgacaaaatccaccctcttgtatctgttgcaaagttgaccacttaccattaatccacctgcctcccagggctctcctcaagaaatctgatttcatttgctgttggttggtttcttctgaaaagtagcttctgaatatcactgtaaggcttttaaccagttaggatcttaatggtgtgagagtgttctattgctgaccttgtcactcgaagtaaaaacctttttaaaaactcacaaactccttggtaggctcttgcctgatgcctgaaatagaagacacagcaataggtcaggaagccatacaattcacggtgagcaggagaaacccatggcagatggcagcagtgatttctgtgtgtgtgtgtgtgtgtgtgtgtgtgtgtgttataaagagtacagatgaatggccaaagagatgcatagggcaaggattggggaagggtctcagagcctccatgccctgtgggtatgccacccccacagcgcctgaagacgttcaccaacctaaaagctcatcaaatctccattgctcaagaggttgatagaaattaatcttcagccctgctccccttctcggaggttggtggatggggctggaagtcccatctctctgatcacagggtctttctggccaccagctttatcctggggctatctagcggccccaccctaagtcacctcctcagcataaacacccatgtgagagaaaggggctcttgaataacagaagacacccctaccacacaggaaattccaagaggcttagaagctctgtgccagccactggagagaaagaccaaatatatttcttctaccatatgatggcacttaaagactattggttcttccaaaacaccttcctctaattgttagagtgaaatcaagattgcctgcaaaacaaaatatggtaaaagatgtatcttttattgaaaccaggccggttcccttgtcctcctcacagggcgtgcaatggtgatgtggctcgcttcttcagtgtctggctactcatagctctaggagcgcatacagacaggcagactgtgggactccgaccccaccacaatgtctaggggtggatatttacagctggagccccagtgggcttgtgttacaggtgctcttttagattgctgtctataggtggcttgcgttaaccagctcaattagacttccttaaaacaaggacacagggatatctgtatctcccagtttcttgccttggtgtaccggaagaatgggatcatatgtgactttaggaataaatgcaaggttttattgagtagaagtggctctcagcagatgggagagccagaaagtacatggttttaccctggagtcaggctgctctgcggcccggctcttctagcttttctctgactgctcagtccaaactacgcgtccttccgccagtcaatggcctgccagcctcccagtggctcttctccctgtgggctctccatgaccaggcgactgaccagccgcttgtgtctacttccgcggatgcgctcctcacgatgtccagctacctctgtgtctgccagctaacatctcaggtttttataggcccaggatgggggcgtggcaggccggggtggtcttgggaaatgaaacatttaggcaggaaatgcctgtcctcacctaggtcggtgggggaagggaagggagactgacataatgttgtctgacataatgttgtctgatctctggcatctcagtaggaatcgaaatgtgctcaagtcaattaggttatgctcttagatgtcttcatgctcattaacaacacaaggagcccttgactaaaatgacactaaccacatgcaagtaaggtgtgatcagacagacccaggccacaaacagttctgcacattccaactgttccattcattgccctttcgggagggaatctgagagctatgcttgatgaggaaaagcccttctctggtagtttgctggtcccctagtggtcacctcatccctgccacatgcacagacacactgagcacccatttgcaagacattgcttacgaactgatcaagggtcagagatgaagtggagggaggcagtattttcagtggacgtaagccctgagcccatgtgctgatgcccaggggcatgtgttgggcactcagggtatgtgtaagcatctgccagccttggacagggaaggagaaccatattatttctaatttatgatttgatgtgacattatgggttaagaggaataagaaattagacttgcttctgtgttaaggtataactgaggtgctgtgattcccattttctgtttcccattttaccttgggggctcaaggacatcccagcatcacctgattatctcttgttagaaaa

SEQ ID NO: 130 - DNA, 17891 bp, Homo sapiens
  source 1..17891: mol_type = genomic DNA
gggttcataacacgattctccatactgttctgtatattggaaacattctgcagtaagtttaacaaattaaattacatttgaggccaggcgcggtggctaacacctgtaatcccagcactttggcaggccaaggtaggcggatcacctgaaatcaggagttcaagaccagcctggccaacatggcaaaaccccttctctactaaaaatacagaaattagctgggtatggtgccgggcacctatagccccagctacttgggaggctgaggtaggagaatcacttgaacccgggaggcaaaggttgccgtgagccgagatcccaccacttcactccagcctaggagagagagcaagactccatctcaaaataaataaataaataaataaaaataaataagtgaaaaaaaaaaaaaggctacttttgccagcaccaagtgcctgtgcgatgcctgggagccaggctcagggagcagcttggaaggcgccactgcactccagcctgggcaagagagcgagaccccccccccgtcttaaaaaatataaatgtatatatagtttctcagtatgtagtttcaaattttatttcaggaaacttttcttgatttacaaatttcactgttctattcactttggatttcttcttcagggactcctattatctgtatgtcagtttcttcccctgtcttcaatattatcactttctcttgaatcttttcagtcctcctttccaataattgttacattttagattcgttgtagatttatagaacaattgccaagctaacacagagttcctatatgccccacacccggtttctcctcttaacatcttacattagaatggcaaatttgtcacaattaatgaactcatgctgatccactgttataactaaagcccaccatttattcagcttcctttagtttttacctgatgtcattttctggtctgggagccggcccaggatgccccgttgccggtggtggttgtagttactctccgcaggctcctcccaagctaagagttcctcacactttccttgttgctgatgagcccatcagttttgaggaggcctggcccgctatcctctcagctggcatgtgtctgctgtttttctcgtgattagatggggttttgggtctgctgagagcatagcttttcacacccatgcaaaagcacacaccaccagcatggctcattgcgtaggtgctaactttggctgcctcgctgagggatggcctgatgtattttttattttaatataaatagcacattcttcggctgctaatcgtattactattcttcagtatttaaaaggcgctagatgctgtgataagcactttaagatcctatttctttctctcaacaacactgcaaactacgagtacaatcctattgtgcagataaacagaactctcacacaaacacacacacacacaattgtggtaaaatatacatcaatttctatcaaccatttttacccgcacagctcattggctccaccacattcccatctgcgaccaccaccctccttctccagcgccttctcatcttccccacgtgttccacgtctcacctctggtcccagcgacaccagggctttcggtctttgggagattgaggtggttttgtgcccgggattaggtgggttcttggtctcactaacttcaagaatgaagccgtggaccctcacggtgcctgttatgtttcttaaaggcagcgtgtccccagtttgttccttctgatgtccggctgtgttggcagttttttctttctggcgggttcatggtctcgctggttcaaaagtgaaactacagaccttcgcggtgagtgttacagctcttaagtctgcgcctccggagttgttcattcctcctggtgggttcgtggtctccctggcctcaggagtgagactgcaggcttccaccgtgagtgttacagctcataaaggtagcacagacccaaacactgagcagcagtaagatttactgcagagtgaaagaacaaaacctccacactatgaaacggaatctgagtgggttgccactgcgagcttgggcagcctgcttttattcacttatctggccccacccacatcctgctgattggtccattttacagagagccgattggtctgttttacagagaactgattggcccgttttggcagggtgctgattggtgtgtttacaatccctgagctaaacacaaaagttctccacatccccactggattagctagatacagagtgctgattggtgcatttacaaaccttgagctagatacagggtggcgattggtgtattcgcaatcccttcgctagacataaaggttctccaggtccccaccagatcagctagacacagagcgctgattggtgcacttacaaaccttgatctagacacagagtgctgattggtgcatccacaaaccttgagctagatacagagcgccaattggtgtattcgcaatcccttagctagacagattctccaagtccccaccagattagctagacacagagcgctgattggtgcatccataaactctgaactagacacagggtgctgattggtgagtttacaaaccttgagctagatacagagtgccgattggtgtatttacaatcccttagctagacataaatgttctccaagtccccactagactcaggagcccagctggctttacccagtggatcccgcatcagggccgctggtggagctgcctgccagtcccgcgcactgcgcccgcactcctcagcctttgggcggtcgatgggatcgggcgccgtggagcagggggcggcgctcgtctgggaggctcgggctacgcaggagcccatggcggcaggggggtggggggaggctcaggcatagcaggctgcaggtcctgagctctgcccggcggggaggcagctaaggcctggagagaaatcgagcgcagcgccggtgggcaggcactgctgggggacccggcgcaccctccgcagctgctggcccgggtgctaagcccctcactgcccggggccggcggcccggccggccgctccgagtgtggggcccgccaagcccatgcccacccggaactctagctggcccgcaagcgccgcacgcagcccaggttcccgcccatgcctctctccacacctcctcgcaagctgagggagccggctccggcctcggccgtcccaggaaggggctcccacagtgcagcagcgggctgaagggcttctcgagcgccgccagagtgggtgcccagacagaggaggcgccgagagggagcgagggctgcgagggctgccagcaggctgtcacctctcagtttcagggcaacaggcccaccccgaatagtcctggagccaaaagggaacgagcttcttccttcaggtggggaatagttcacggtgctgcttccaacgtatcttcttcctcgccgtttcctgagacttctccaaagcgggggccgtggcgcggcgtgctgtaggcgctgtgctggcgccgtccgggctcccgagcgggctgagggccctcccctggggctgcgccaccccgctccgaggcggggcccttcctggaaccggcttccctgcaccattcctgatcggaggctgcgaacggcacaagcccctgcggcgttttgagtggggaagtgagccggggcctgtgcctcccggggagccgtgggcaggtgcgtggccacggactgggctctcggagcttcccataaaaccccggagacccactcagcacggctgcgggcccaggcacgctggtgctggcgcctctcaggcaggacgactccacagccagcgggagaactttccagatcgccctgcgcagatgctcccctcgcatgaaatcactgctcagcgttagccgcgggccaagccccggcccagccccagggaatacttaggggactgcaggtgcaggccgtgggggcggccgggctcgggccggctctgcagaccccgctccacgcagagggcgatgctggggactcgcagagctcgagaccgctgagcttccctcactcatgtatggcttaaagttattcatgctgaactccagcttagcacattgttgcacaaacacagatattcattacctggcatttttattcaaacttcctcaaagccagttaagaatatcagaaacacaagtaaattaatattaattattcaggtgctttagtcacttcatccaaagacgttccagcggcatggtttctttggattcatataattttcttcgtattgcctggattccacaagcatccgttcatgagacactgcacgttgagacggtaacgcccctaggctgcaatataatgcccaccttgcgcttgctcaccagcatccacctccaatcctggctagaaaagtgccattcttttcactgttcgagaaagggcaggacagtcatggaacgctcagcgcagaaatctgaatccttagatggacaaactgtgctccctccatttttccggttttgcagtctgtgatcattgctcgagttccacagggtgagatgtaaaagacgcttttccttgtgcttcttggtacactgaaccgaaaacgatactgactcccccaacctgtatgtatgtatgtatgtttgcatgtatgtattttgagacagagtcttgctctgtcgctgaggctggagtgcactggtgcgatctcggttcactacaacctccgcctcccaggttcaagcaattctcctgcctcagcctctcaaatagctgggattacaggcgcgcgccaccatgccaggctaatttttgtacttttagtagagacgcactaactacattagtagttttgctatattggccaggctggcctcgaactcctgacctcaagtgatccaccctcctcggcctcccaaagtgctgggattacaggcgtgagccaccacgccaggcctccccacgccgtatttaaacacattgacgaggcgtccaacttcctgcatgcatcttagcaggagtgcgctgtgggctcatttttacggtctgcactgggttgtgtgtggctggctcaactccatctgaacagcacagcaatatgcccactgaaatgctcaattttctggacttccttgcccctaagtgcatgtggccacattccagccagtgaggtgagaatggaagtggaatgccaccttcagggaagcctgatttaggaagctcactctgcactcctggaatgtgaacatgatgactgggatcccgcagccatcatgcgtcctgaggggacagtgagactaagaactgtgtcatggtggaatagaaaaacagatcacggttcagcccgggagttgcgctgtccgacccgagctacacgcagctcaatttctatcttgtgtaggccattcttttctccaacctgttagtagtaatcagaacggttcctaaacgatatatgatgtgatctgcaccatttccacgtttcagacgaactaatctcattagcagggcagtcctcaacgcattccactgtcgccgccctcgcaagggccgccagtttccaggatgagcaggctgagccggcatcgctgtctggggactccctattctgaggagccaaacgtccacacctgcctgcattgctcctcacttgggagcggggcgtgtggggtccccttccttccatgctgtgctgcgtgagttcctgctgtcttgtctaatcgtctccttcagtcccggcctaagcaggtaggagctcggggctgtgttccccgcgcctcctccgcaggaagagtctcctcgcccctgctcctgtctcccaaactctagatgccacgtgggcgctgtagccccacttcgccaatgccttggttcgggcgcttcctgagactctcattttcctaatttcactaacttcacaccttcttgctaattctgattatttttcctctgcgatagggacttcgctcaatggtgttcatcagcattttttccaatattggtaatggtcttccaccgtgtagctccacacttacatgtcttcagatttttctatctccctatagaagaaagtccacctctgtgggtttgttttgtttttgcttttttgagaaggagtctcaccccatcgcccaggctggagtgcagtggccggatctcggctcactgcaacctctgtctccaagctttaagcgattctcctgcctcagccttctgagtagctggaattacaggcatcagcagccacacccagctaattttcccaactaatttttatatttttagtagatatggggtttcaccatgttggccagactggtgttgaactccttacctcaagtgatccgcccgcctcagcctcccaaagtcctgggattacaggcgtaaaccacccagcccagccaacctctattttttttttttttttttttttttttttttttttttggagacagagtctcgagtctcactcttttgcccaagctggagtgcagtggcgagatctcggctcactgcaacctctgcctcccaggttcaagtgattctcctgcctcagcctccagagtagctgggattacaggcgctccccaccctccccacacaccacacctggttaacttttgtatttttagtagagacagggtttcaccatgttggtcaggccaggctggtctcgaactcctgacggcaagtgatctgcccacctcggcctcccaaagtgctgggattataggcgtgagccaccatgcctggcctatactgtgttttttatttgtattactttttattgtggtattatttgttttgttttgatctgtggtgggttgaacccacaaatgtcaaatggggaacccaccaacatggaggaccgcctgtatttggaaaggagtaaatgtctctgccacttgctccacacaaagctagactgaagcagatttgttagcattaaaatcgtcatcctgggggcatttgaattaagaattttattttattttttttagatggagtctcactctttttgcccaggctggagtgcaatggcgcaatctcagctcactgcaacctctggctcccaggttcaagtgattctcctgcctcagcctcctgagtatctgggattacaggcatgcaccactatgcccagctaatttttgtattttttagtagggatggggtttcaccatgttggccaggctggtcttgaactcctgacctcaggtaatctgcccacctcggcctcccaaagtactgggattacaggcatgagccactgtgtctggcctgaattaagaattcttagttttctacttagaagccatcatttttcaagcagaatattagtttttattatctatcttaataccaatgtcttcatttgtatttttcttgctcatttagcactcacagtttacagagccccagacacagctctttccaaccttatctgtaagggcagcaaggttgtttcacacatgctaatataacaactattaaaacggattctgcttttccctcttgcagtctacttttctgcccccgacatgggaggttatagcatttcttgtctccactctctcccttccacacctaacagcagttattcaacttctgcttggaatgccactgtatgccaacaggagagggtgtctgtccttggggactcccctgtgccactgatgaacttgtttggggaatgttaagtgtctctactgccttgattaggagaagctgggtgtgatggttgatttggagtgtcaacttgacgggaggaaggggtacccccatatctggtgaagcactcattactctcaaggcttcaggaggctctgcacctgtcctcttttgcctaaagggaaacccatgtggtctggcatttggttagattgggctgcctcaggtgtgcccatgaaggtctttctggagactggcatgtgagtcggtggactgagtagggaagacccaccctcaacatgggcaggcacccatccaatcagcaggagcctggatggagtgaaaggcggagaaaggcagagaagggtgcattctcactccctgctggggctgacgtgcttttctgcccttggacgacacttggttctctggcttttggactctgggactctcaccagtggacctccagagttgtactattagtttcagacttggactgaaacacgctgccagcttccctgttctcagcttgccggaggtgggttacagaacttctcagcctccatgatagaggtggccaattccccatcccctgctcaccttcctctctatcgtgttggctgtctctctggagaaccctaagtgaaacaccagggaattgtgtgctgggctaccttgccttcgcctcagcctccttacattgtccacagggccaattagaaatgtgggaacagtgggtgaattctgctgttcaggattgcttttaaagggcccagccacccagatgtcacatgccacatgctgtctggtatctgtctggcaagggtcagctcagggatcactccttcagtttcccgacactccttccagtccaaacatggtggtgggttttcacaccaatcccattttgacagctgcagcatttcacgtgggccagggactgttgggaagaatctacccaaacacacaaagggttaagtttctgattctattggttaagatactggtttttcatcaaaaataaatgaccgcatagggcagtggcagacacggcttacttcagagatgcttctcgtggtttccagagctgtcttggcatacatgcctgcctgtcctgcagaccacagggtagagtcacatcttatctggaaagctcgagtcttccttgccactgccctttccaaactggggacttacgtggccatcccccaaaaaattcagtgccaactactcctagtacctctgcttcagatttcgtaagctcatttctccacatctaagtaggtatcacatctaagtagctatcaattcatttctgccacagcacttatgactggtttaattacatatttgcttatttacaggcttgttgttttaactctcccataagaccacaggaagtggactgcagtcgtcttcccccatcactgaacatccgctgtctactatagtgccaagcacataggtgtgttcaataaatattcatcgagcaaatgagcaatattccactcattccaaatcgtttgggatggctgcagcttagggtgccttatcatggcaggcgggtgctgagactttttgacttaaaatgaagacgaaattgtctaaggcgccataagcgaattttaaggagggtaacagtcagatcttaaattagttgggagctgtgctgagtgggtaggcacaaacaggcatgtctaggcaggaacctgctgctgtgagctgcacaagcaaggaaggtttaaatcaggggtgtccaatgttttgacttccctgggccacgctggaagaattgtcttgggccacatataaaatgcactaacaatagctggtgagctaaaacaaaacaaaacaaaaaacaaaaaattgcagaaaaagctcatcttttaaggaagtttacaaattagtgttgggtcgcattaaagcaatcatgggcggcgtgcagcccgtgggccatgggttggacaagcatggaactttaaaccaaggcggggcagtgggagcgagagtcactgtgcagaactgacaggactttgtaaccaaactggacgtgaagtctaagtggaggaactaaagatgaatttcaagtttccagggggtgccacaaaataaatggaatacaggaggaagaggagatgaaaagagggaaatcacgttatattttagagggtaaggaattcatgcaatgaccacttagggaactggatatatggtttatagctctgaagtgacatctggcctggagttgaagaagttgtatgtaatcagcttacaggtattaaagacttgtggaaaaatcagatcacccaaggttaagtgtgttaaaatcaaaggcccaaagatggagtccttggaaaccccaatattccagtcagacagaagaactgagatgaagaaaacccagagacaagtctttcggagtctaaggagaaagtttcaaagacagagttcttaatgatgctgccaagaagccatagaagggaaaactaaagagcagtagctttattaagctacagtacaagctaagatgacgtttctgggtcattttgggagtgggggtagggtatgcaggaagagagcagacagaggtagccgagtatagatgattctttccagcagctttgcggacaccatggaaagatcatcttcccgtactactttgtagtataataaacttttcatgcatccttcaggaaagatttagcaggaatagtttacatactcctaaaacagacctagaaaacctggcatataaggcaaaaaggaacctaagtcatttaaatttaaagatatgaaatagacgtttttatgaatattatataaatttcaaagttggcaaaacaaattgttacatatattttttgagacggagtctggctccattgccagactggaatgcagtggcacaatctcggctcattgcaatctccacctcccgggttcaagcgattcccctgcctcaacctcccgagtagctgggactacaggctcccaccactatgcctggctaattttttttattttggtagagacacggtttccccatgttggccaggatggtctcgatctcctgaccttgtgatccacccgcctcggcctcccaaagtgctgggattacaggcgtgagccaccgcgcctggccctggctttcttgtaatgggaattgtttggggaaaccacaacatccaacacaggaatgacgctgtgatttttaaaactgccctgaactgctgtgcttgcttgaaattaatgtcgaccttaaggcaataccattacccatattaatattctcccaagtaataaaggaatatcataactcttctattattgctttcacctaacctgtactattaaggatagaaagactattgaagggcaactataaaaacctttttttttgagacggagttttcactcattgcccaggctggaatgtagtggtgcgattttggctcactgcaacctctgcctcccgggttcaagtgattctcctgcctcagcctcccaagtagctgggattacaggtgcctactaccaggcctggctaatttttttgtatttttagtagagatggagtttcaccatgttggccaggctggtctcgaactcctcatctcaagtgatccacccgcctcggcagtatgtcaattgcttgttacagaaattataaactcacaggaaaatattcattatttgaagcagagctgtcctaagataatgcacacaaaccaacaaaagactatttaacaaaaatatttaatgctgccaaaaagtataaaaatacagtaggaatggcagtacaatacaaagtaatctcccctaatttatttcttgtacatctttctacatttcatacactcattaaaaacacttaacacatccaattaaaggttctgcaaagtcttctgctggtgggtgctcttcatcccctggatgtaaagtttactttgtaaacaaacaactgtgaggcaatctagagggttagcgagcctcactttagtttccggagtgggcttcaggtcttgctttgcacatcaatggttcaaaatttatagctgcagaatattctcaagtcatgaatattaggtgtctgtcaatcttggcctaaaacataaaataagaagtcatctattcaattcatatttaccaaacacacagacgaacatagatgcacacaaacataaaaggactaacaatgaactgaaaaggtgaccaaaaatcattcccacatgacacattcaaccacactaagtgctgcactgttatcttagggtaaaacggctggggtgctggatttccaaacgatggtggtgtgacgcggcctcatgtggaagcatcgtgacttatattcttcttcaagaattatgtgaattcttaaggtcatcttattttactcaagaagtgacctctgtgtgataccgacagacagacaggttttaaaaataatgtacccacaagaatttagcaagactttatactatgtgctagacttaccaatactttggaattcaatgcaaaagtctaatccaatttggacctccactgtgtaatactgctaaaaatattatcaacataatgtttgaacataaagttggcctatatttttaaaccacaggttgttagcagatgctttttgtcctgaaggataatactaacaattatatctaccgaaatgaagtgacccaatcttaagctactactaatataaaatacataattgacagatttattgtattttaatgccataaagtaaaaataaatgagaattcaaataagcaacagatggatggaatgactattgtaagggcagttgagtttttgatgtcacctcccaaactttgcaagtaacaactttttaggaggtcaatggtatttccattcttcccccaactcccctcagtaccgcaaaacctccaaatctaagtacttgtcagtattgtatcttcacatatatattaagaaataggaaatacaaatcatatccacacatttagtcaaaaactcccaaatgctgagaattaggctactccctttaaagacagggcacttggcataattgtaccaagcaccttggtgttctgaacgtcctttttttctctgattatccaacagtgacggagaaatgtcaagtcatcaagaaaacattctcattagataatgtgagcccacaactactatgggtgtttattacatgaatcttcagaatgtgaaccaaagtggctgaaggtactttgtattgattctgagtgctgcaaaatatatatgttttccatgcatccagaagtctttttaaaataagcaactcaattcaatcaaagtgaatgaagtaatgatctggtttagagaatactctgatgttctagtatttctctgttgcagtggtagttcaaactggtgcacaaagttttttaaatgtgctccatttaaaaactagagaattactttggattttaacaggtaagagtggttgtctattactttcccacttaaatatctcatttaaatattccattaaaaacagagtccgtgtaacataaaagaaaaagtatgaggtttggagttactggaagtctacagactgcagagtgaatctcagttctgtcatgtactagctgtgcaatcttgggcaagttacttattctttgactcagttttctcatctgaatatagggagaatgctgtttacctagaagaggtgttacgtgggttaaatttagattatgtatttaagctggctggcagaattttaagtgttcaccatacctcatgtccttccccagtattttgttacagatatacttaccaagaatgaactatcatttataacaactgaaggacggggtttttaaaaattcacgttattatttctttgtaaatattattcagggtgggggggtaagaaaatacggttaaatcattgggaggcttaattgttttaaagactttacttgcaagactgaaaagacaaatgggctccattttagaaaattctaatagattcacttgaatcaatttttgctatttttatttaaaaaggcaaaggcaggagaaacgggttcaaataagtcaaatgaaacaaacgtggtgctttctgtggagacagtggctctgacacaccactttatgctagaaaggcgcaagggccgggtgggtgtggacagagggtccactaccaagtcagctctatgcctgaggccacgaaaagccaaattgcaccaagaataggttttgccaccagatatccacactaatattctactaaactgaattgaggctaatcagaaacttctcttaaggtgcaaagatgctctacagatgacttacctaggttcccgctcctgaattaactaaactcaaaataactgaagtttttaacagcagaaatttgatgtatcaagagcaacctgtgtctgaaaaatatgccaaattagagccacaataaagaataacttgatgcgtctttaaaaaatggtctgtataaagaaaaaaattcctgtgcaattcttggagctcctcaaaacatactgtataacgtaaaaccagaaagtcgtgaagcagtttctgtaacatcttcaccaaattgcataattcccaccttccattctaaatttaaaaaaataaagtaggaagagttcaaaagtttgaacttttcaaattctcccaatggatcgcccagagagggggatcagggcttttttttttttttttttttaaatagagtggggtttcaccgtgttgcccaggctggtctcgaacccctgggctcaaatgattctccagcctcggcctcccaaagtactgggattacaggagtgagttaccaagccaggcctggtcagggctctttgaaatgttttccttgtcagactgttaccctttagagacaaggcctcacaaaccaagtaaacacttctatccatcactccttacagtcggcgatggcttcatgctgggctaaatagtatacaacaggagaaaaggctcagcaatggcagtgaggaaaaatgctcccttccctgaaggacaatgagtctttccagaacccagtagacaggggagacagccttaggagaaagcacatgtacagcattgctcaatgctgttcttggagcaatctgaatgtgctaaatattcagaaaattcctgctgccgagggaaaaataaccaaactcatactattttcctagaagttcttacttaaataatactacccaaagaggagtgaaaagcttaaattctcaaatctggatgaacaacataatggctgtattgggagcaggcacacagaacatagccactgagtgtacagttttggaactggagagctcttggtagagcagggattgaggagtccacacaatctgagctgctttccaccaaggcatgtcaccccttatacatattcactggaacaaagacagctgtattttctagtatatctgcacttctaggggcaggtgggattacaggagtgagttaccaagccaggcccagtcagggctcttggcaatgctgtcccatagacactgctttgaagatagctataagggaaagtggaattgaaacgaaacaaatgaactggggagaaggatgagtggaacaggtcaactccagagtaaaccatacaggtggtttttaaatcgtgaaaaaatacatttctattcttcaaaattttatttataaaattctaggcctctaccatgtaaatatgccaaagccaaataagggtttcttaaaagtaaaagagacttcattagctgttggtgtatcaatgggaacgcagaacaggcatttctgctgtgcagttagttctgctatgcactgtgcgtccagcacagccaggcgagggaggacctcagacatctcccctgcagggtgcaacagactgagagcaatctatgccccggctacacatcactgagaacccatgtgtgcacctgctagaaaaacagataaaccaatgtttatagaactggaactcctgcctgaacacagaaagaaatggactacatgcctaatgacatttggcttataatagactacatttttaaaaaacatatatttataaataatctttaaaatatctttatttttatatctattttatatatctctctgtatgtgtgtgtgtgtgtgtgtatatatatatgtatgtatatatgtattatgagagacagagagagagagggagagagagacaaatatacagagagagacaagtctcctctactgcccaggctggagtgcaatggctccatcatagttcactgcagcctcaaacttctgtgcttatgtgatcctcctgcctcagcctcttgagtagctgggactacaggcacgtgccaacatacccagctaaatttttcttttttttttaagtagagacccaggctgatcttgaacaaactcctgggctcaagcaatcctcccaccttggcctcccaaagttctgggaatacaggtgtgagctactgtgaccagcaaagatctctttaaacatgtgtatctgaaaagtaaaaatcaaggcaggctagatttttaagtctgtacaacaaccaggcaggcaatttgggaatgtaggtactcattatggtatacaatagtcaaccaaaacacttttaataccaccaggttctggtctggaactagatatgtaatctagtcagggatattttttctcagagggaagtgagttgcagttgcagtcttcctttgataattatctacttctaggacatgttacacatctgagacttttcaaagacagcaccataaaaggatggagaaatgccagtttcaggctaacaataactacttcataaaattgtgttgaggattaagtagggtaatacgtaaagaaaaaatacagtgtctggcatacagtaaaccatcaataaatggtgctttgaactgactgttgaaagcaaaggagttgatataaaaactggaagactgtttcatatcataaactgctttttaaaccaatacacatttttcgattcataccaccaactttagtttaagacaaagaggacaggcacaagtgcacattagcttacagtcagaaccccttctgctgacataccattaaaagaaaatgattaacacattttttttcttcctttctcttttcttggtcattccttggtagaaatattaaaacaataatgaaatggactaagaacataaaaggaccaaaagacagaaaacctcacaaatgtataaagtctcctctaacacaagaaatggtctaaagtcctccatgtgcttattacatgttacttttcttaaccctttaagaatgcagaaaatgggtattttcatttttatatggatacattaaacatggagaattatatttttacattctatatatgtgcaagcatagataaaactcagtcataggctaacataaaataaatacttggttaatattggaaaggaatatataacttgttggtgtagctagagaacacagcattaaaccaaaggttgctgtcaatctattagcagaaatagatatgagtggaaatgaactagatatgaattaaaaactcctgaaaataaaagaaacattttttttataattttttcttccttaagcaacactacatcattcaagtcaaagtatatatctgactcttaaaatctgttaaaattagaaaatatttaatattatgaggacctaaggatacaacaagttttttaaagctgtagaacccatctagaattgctaactttttcctctggctgttaccagagaaggcagccacgtctgtctctttgaccagcacacctcattcaataaaaagtcaggactttttatcatgggcacaacacgatgtcatgtgttttcatgacatccaccaaaaaatattattactggtaaaaactgaacactatttaaagcatccactgtcaatgcccttctcaaggatctgctcagagaaggaaagatgactaaccttagaagtgtaccaacaagtgttcatcacactgaatgtggttttaaaaatatatgcgacaccacccagaaggacagaaagcatacagaaagcaaagcgtaagccaatgaagcgcattcagccagctgaggggtgaggcacgtcctctctggcactggcttcctcaagtcttcacctgtgtaccgaaagcaagcctagtttcaactggaaatgtcataaggtctacctgtatgtgacttgcagagtaacataaacatactgcatttagcaaagacaaacca

SEQ ID NO: 131 - DNA, 3149 bp, Homo sapiens
  source 1..3149: mol_type = genomic DNA
ctatctgtgcatgtagaacaagttttagtgccttgttaagtaatcatcacacagagtggttctcactatggactgacaaaacatttgctgatccacaataatgaaagtcattagaagataccaggaagtggatgtttcaagcccatatcctcctatggtgttgagagcattgtttaggaccccaaggacacaatcccacagtctgttctgtacaataataatttatgccatcaaatcatctttcatcagagatctcaaagggattctgcaaacactaatttcaccttttcctgaggtatgtagaaatagtaattccagaggaccaggcaaagagctagagaatagtcttgacttgttcaactcctgagtgaatgggaggctgaaagtgaaccagccttaggaatggcaggcatgacactgtccaggactgaacttcatctccactattgtcctgagagagttacagaaagcctcttttgtttggaattttctcaggaacccaagtgaatttgggtggaaatgtgtcccttatgaaaaggagaacatttcttgagtggaagttgttataagatgatactttctcacactatacatagagacaggggccatgagagttacaaacaaaagatgaagtgacttgatcatgtccttaagttacggtgctcctagctagaactactcaggggcctttagttatgatgacaacaggtccaagtattcccagtctcaggttacaccttttgttggaacaaaattacattggtctctgtcactctcaaaagtgttctggactgggtgagaatatataagatcaccttaactgaagtgcatagttctacacttagagacttctttaaaaggaagaaaataaccacagtgagtgaagaggaaatgctccacttatcctcaggtttctcataacgaatacagacaatgacattcacctcgcagtgttgttatgaggattagatgcagtgatgcgtggagtgtctccaactcccactcctcaaaaagtgcctggaatgtggcaaactctcaagaagttcaaatctccattcattttccctctccctttatcacagtgaaagaaaattctaacatgagttgcaccaaagaaatgtaagagagttaaagattcttcttaaacctagcatcatcagtgacacagcgattttcaagaaattccaggaagcctcaaggacactagaattccttttttggaaggatataagatcagaagatggaagcttggctcctcctgacaagatgtcaggttgcatgaccatcctatggtttgcaggtggtggaagctcagctaccagatggggctaaaacttttggttcagattaatctcaattaaacacaaaaagaaccttctgattaaactacctaagagagcatgaggggcctcaccaggtactaagtttcttgccattggtcaggtcaaatatgagtgagttaatccctggttataggaagtttccattttggatggatggttagtctagtaccaggccttttttctgcctagatatgtccctcattctggtattgtagagttctggtatttttcaggaaaacagacctagcttatttttttccttttctggacttctaatgaaaacaaataaaaagtatactttagtttttgtgttttctgatggtgttatgtatgtttattcaaaaggaccatgccctatactcattttgactattccacaattcttattcaaatgctgagcatacagtgggtgcctaataagtacttagaaactagaaatgcagacatgttcctatagattttcccatgcctatcattaatacaaacttggcactatagtcagcatcacctgtggccatacaatgtatattattcatgtcgtcacatgatgccaaaaacatgacattcagcaaacactaaaatacataggttctcagattgtgactcaaacttttgactacagagactaaaattacaaaagtctacgtcaacttgactggtattaataaaaacataatatacttaaaaattacagtaaatagtgcaaatgaagcctgatcaaccactaaaacatacagatacattaaaaacaaccataattgttgttcagaacataagacatcctgcggtattcttggtgtctgaatgtttgaaaatgtttaacatggttagatcaaatataaaccaaaattaagactatagataacatggaatgaaagtgacagaatctggcaagaagattgttcattttaaatcagctggaagtacttgttaaaatactgtaattaaccattatgataaaaatctttttaacttgaagaaaaacttatctaacatactattagaacttagaaatatatgaatagattatttaggaagctttttccagaattattggtattttgaacttaaaatacagtatttagtctataagaaattgaagtatgcaagtatctatatttgtacaaaaccacaaatgcaaaatatagtaataactattgagatttactctcttccctgttgcccttctcttggcttaatcctacattttctaaaaggtatttgttgttgttgtcttcacttcttatttatccagagaacagcccgataaaattgcttctgccaccctcctcttctaacaagtccactatgtaagaaaggcaaataatgtggattttccataaacagtatgtgaaaccacagcatcttgaatctttgttgatttaaaacttttggttccaagttacagaaactcagtctaaactaactgcaaccaaaaagaaaaacttactgatttacagaaacaaagaattgcagagaggggacaggaggctcaatggacgctgtggtaagggacaccaacactgccagggacttatctggccctctttctgcccctctattcacctccactatcttctacagcagattaagttgtgccttcatcagcagagaagtgaagcttttttctttttaacggccatcttaattaatctcaagaaaactttgtgcagccattcttgagtcatgtgtttacccctgtggctcgatgagattattatgattaagatctccctctaaaaatatgaggttaaaaggaaaggaggatggattcttagaggaaggtctgtgctgcctccaggagaa

SEQ ID NO: 132 - DNA, 125657 bp, Homo sapiens
  source 1..125657: mol_type = genomic DNA
aaaaaaaactttttaaatctccatacatagattcttattcatgcattgactctgcaaggatacccaaagccacatcgtcacctctggggagaactcggtggctcttcattgaataaccatctgtactgcacaaattttgtatcacctaaataatttaaaaatccaaacttttaataaaattaaaaccatcaaaggtgatagcaagagggcaacgcttaaccctgcggtgcaacatactgaatttcaggcaaaacagtcctgtgccctcttcaatttctacacaagaggagccagtaatgataatcagagaccagtaattgaggcggggactttaacaccgagtcaccagaggtgaccttgcaaacttggccttttgtcataaaacaggcacaatcatcactgtgttccagccctccagggctttccgaatgccagtggctctggggaaggagacctacttttcgctctataggaacctaccatgtgtttcctgtttccttccacccttgcccccacgcactcacccccaacccctgccccacctccacatgctccctgcacccaccacaaatggccacactcacatggacagcaccttcacttccaatatttcgtgcctcagctccaggcatcttgtggagttatattcaaaaggcccctcataaaattcaaagtacctggggaccaacagagacaggttaaacagagaagcaggtcaggatgtccagggcctgcaggggctcttgttgcagggtggagtgtctgtcccagtgaaataaataaagccaaccagccccatcccagcagatgtcccattaggggcttcaggcagaccatggggccctctggcttgatcactgggtggtcagttactctcagcgccccactcccttgggagtgtaggcatttacagaggcataaacagatttcagcacacagggaaattcagaagcaggtttggttccaagtttgtggctgggaaggagaggggaggaggagggatgctgtgtgtactgtgatcagagaaagcagagagaccagagccattctggcgcagcactgggagtccgacagtgagccttcaggcctccaacttgcccttccattccctgcccctttcccacttgatcctcgtgcctacactgtgacatagctgagactgatgggcctttctccccatttggcagctgacaatactgaggctaatcagacagggctccaggtcatactgtccgtgtagggcaggaccagggcttggtctaggtctacttgcagaacagaacaagccccttccagcaccagctggctccaggcatgtcacagccacctcagggtccctctgccagcttcatgcagaatatcaatgccaatttcaaccaacacttactaagcccttaccataggctaagcaccaggccaagcatttgatgtgaatggatgcattcacttttaatctttctaatcagcctatgaggaaattgacacaagcatcctgaacaggctctaggaattaactaaggtgcccagacccccggagctggaaggtggcagagccaagatgggaacctgcatgctgactcaaggctgctctttctgccacttggctatgagcacggctggtgtcccctggaaagggccctctggcctcctgtggcagaggcccggtgagccctctcctcacagcccccctcctcctggcggttgttcagaggcaggggtgggtggagcttggagggttggatcccaggacagccttaacatcatgaatccagaagcctgcagggccaaaccactataaacatgggatcagtggcctggcaacacgtagtctgcaagaatcagaggtgagaggggctccccagggccaaggattggaaattaggcatcgctcaagcatctcccagaaaccactacacacagcagtggtcatttcgcacgtacccttacacactggacaaacttatgtatgtgctgctttagaaatcttgaaatattttacccaatatattggcttcttttaaaaatattggtatttttattattattatcattgtatttgtattgtcattttgtcattaaaataatactgtgatactttaaaagttatgtttataaatatttgtccttaataattttaatatagttttaagtactataattacatatttaaataattttacataatattttaagatattaaaatattttccacaacaaattggtccctatttacaaaataaattggctccttgttctcatgtcataaaagaatttagaccaagttaataagaactaggtattgaagattcccaaaatatcaaacacctttgtgtcttacagctccttttctttctcatctggcaaactcaaatggattcttcagtacccggctcgagtaaccacactgctgggaagcctcctctgaccctgaccctgggctacccctgctcactgtctcttagagcaaataacatggtattgggttggtacaaaagcaattgcagtttttgcctttttttttaagtaatggcaaaaaccacgattacttttgcacctacataatagtacaattgtgtgtttatgtaattgtgttcctttccaaaccacgagcatctcaaacacagagacagtgtctttgttatctctatatcttctgtactacagagggaggaaagctaaaaatgacatttcccagactcctttgcaggtagggttctggatgcaatttaggttcagccagttagaagcatttgcatgagatggattcagacctgttataggggaagaatggcaaggctcaaggcatggttttgctggtgcagaatgtggcagaggtggcatggctcttggaaactgcagtagtggtaacaccttcatgattatatcagaggcagcagctttcacggtggccccatttcactgcaatttggggaggaattcttggaagttcagccatttcttcagctttccccatgaatctgagctagctgtgcccttaataaatccttttctgctttaactagctaatgtagattctgttatctgcaaataagaacaaggggtcagcctagggccacaaaacgagcccatgaccttggctctaactcacctaattttccagtcacacaacagtgagctctggtgtcctatcacaaagatcactgtttgtaacatgagctggtgtcaactaagccctttggaatccactgagtcaggtaaagtcatggtcctaggttgctgctaagaaaaggtccagattcaaatgatgcaggaaatcattaggtcgagacttatcctagagttattggggaattggggacttgcagacacatctcggatatggctacaaaccagctgtgtgactttgggtaaaacttcccctctctgcatctcttttttctcctctttaaaacaatctgtttgaactagggtagtacctcctcttcaatcagccagcccttccatttcctccacaaaggcattcctgccttgcctcttccttggttcctctttctcctgcatcctcaacatcactcatatacccaactaggcagcatcatgattccaaatgaccttgtgccgtggttttggtggtgcttaggtagagaggctttcagaactgggttcacatccctccacccctcattggcctctgtatggtctgaatgtttgtgtctcctctacaattcatatgttgagatcctaacaggcaaggtaatggtattaggaggtggggccactgggaggtactgcaggcagagcccccatgaatgggatcattgcccttacaaaagaggcccaagagagactcctcttcccttttactatgtaaggatacagcaaggagatgctgtttatgaaccaggaagtaggtcctcacctgaaacttaatctgccttgatcttggacttctcagcctccagaactgtgagcaatacatttctgttgtttataagctaagtcactcagtctatggtattctgacagccacattaggcctggcacttttctgctcctttgttttctcagctgcaaatcagcaaaaacaatgcagtgcatgtgcgacagggttgagaaaaaacactgctgagcatttcatggaatccactggcacacaggaactaccccaaaaatgctcattcccctctgtcctctttgtcccgccactaaagagcacgtgataccagtggatgccccaggaagtcccagggagtcagagacagtctctgatggtaagctggttgatggcaggcctgagtcagggatgaacaactcgaagtttctcactgtgtgcactggtgacatcctccttctgctgtgattagtaaacctctcccctgtcaccctgtggataaagcccacactaagtcctgcttggacatggacctgcttgatcacctcatctcactgaggctcattaaccatgtgcttctgatgctttgacacctggggccttgctgaccctggagggactgcctcttctagggctagccaattcctggagatagtaaaggactagcctgtgagtgcacctttcatttgcaaaccaatccagagcccatgcccctatcaggctcccatactcttggacactggaatagctcttccccactcaccccagggccaggtcctaggcaactagggataacccctatgccccagaacccactgaaattactcagatcaaccaatcctaaacctgcaaaccctgcctcaccagttcctttccatggaaatcccaacgacggctcttgcccacacttccccctcgctccctctgcctccttactgatctgggtgcttcttcccatggtcctgcagggcctcctgtttctagggatctgtgagtatcaaaacctcttccttcatgacagtcatttccatattttcgtgtcttaccatatccgattaaaacaaatcccaggcaccctgaaaacactccaggtagtaccttagccaagtcatcaaaactattccatgcctgagtctaaagcctcagttttcccatctggaaaatggagctaatagccctggcttccttctctatcctacctgggctctgcttttttggtccgtactgctctagctcagtctgtagagatgattgacttgaggttgctatggtctaaatgtctgtatccccaatacaaacattaagtttcatgtttaaacttaatccacaatgtgatggtattaagaggcagggcctttgggaggtaattaggttatgaggtctctgccctcaatgatgggattaggcccttataaaagaggcttcaaacagccttttgcctttccaccatgtgaggatgcagcaagaagctgccatctatgaggaacgggccctcgccagacaccaaatcttctgccaccttgatcttggacttcccagcccccagcactgtgagaaattaatttctcctgttataattataaacgacccagtctaagctattttgttatggcagcccaaaagaactaagataggaaataagattttgagaagcactgtcccatattctgcttctaacaggacgctcaagaactgcattttggagggtgtcatggaaattcatggaaattcccatttggtctggatacagatatacagacatcaaaaatgttgcttaaagtttttttgtctaatgacataagaagatgctcacatgacaatgttgagtaaaaaaatgcaagttacaaaactatgatctccaaaaagaattatatatacgtatgtgaaagcatgggcaaagggaagaattgtaacacaatattaataggggtttctcagaataaatgggatgatgcgttatttttttaaatacttttctgtgtttttataagttttctgcaatggggttatgattcttttattattggaaatcactaataaattcttttttaagtcccagaccttcttctaactatctcaagcttccccttaccctgttacaagattgagggaagcactttctccaaccttcttaaactccactagcctctcaaggtgagttcgtcactgtctctactttcaatgctagaaagactatctttacccacatcaaaggggagggcaccctggcaccatgtagggcatctcacaggtataaatagtcccagcgggtgatatcaggagcccaactcctctcaaatgccactcagtttccagcagccaaatatgatgctggtgccaggctgcatcattctgccccatctctctgccctccactaagtgagaagacaaatgcagaaggccagaaagaggtgaacacagtggccctgggcatcagttctctccctgcccagactgggctccagctctgtgggctaaggaggcctcctttctttttcttcctttccttctttccttctttcttttctttctttctttctttctttctttctttctttctttctttctttctttctttttctttctctctctttctttttctttttctttctctctttccttccttccttctcccttccccttccccttccccttcccttcccttcccttctccttccttcctttcttcctttctttctttctctcttttttttttttttgatggagtctcgctctgtcacccaagctggagtgcagtggcatgatctcggctcactgcaaactccccctcccgggttcaagtgattctcccgaagaggctcctttcagcatgcccagggtctggccctctgagagcctgggtctgtaattcctatgagcctttccccaaaagcctgccccacagaggctcccctgttggcctgattccctctccagagcttctccagggccatgtttcctttcttgggggcaacagtactctgggtcccagcaaccactggctgctacaagatgaggtccatgcattcagctttctatctaacacttccccatccccacccccagacactgatggtactccagagaatagaagcccaggggggtccctgtgtcacgcacaaacacctgttaaatctccactagccctaggtgaacagggaaactaatctgaacacctagactcctgtccagcttggtgcagagtctcagagaaccatggagttgtttatttattccacactggttagagacaccactagcccatatagcgcctctgtgcaaataaggaaaaagcaccattttccccagataaattaagccacatgcaccagacacatggctggtcaagtgagagtaagctgtacttcagcctcacttgactgcctggctgagtatctttgtgcagtgcccaccctgcacaactgtccatgacagcctgataccagaccatttaacttggtctcatttaatcctcccaatagccctatgaggcaagcataatttcccccattttatatctgagacttgaactacaagaggtaaagtaacttgcccaaggtcattcagctagtaaatggtggcactggaaaagaaacctgaggactgtgagagcccggaacccctgctcttaacagtgtcactgcacttcctctccctgactctgacagccatcgttctctggggggttttctcagtcagcagcccttccccctcccaaaggcaacagcccttcagtgagctcagcgctatttctagagccagaacagctgccgtctcgagatagcacacgacccgtcacagcaaacgcacagaaatcagtctgaaaattgcagcctgacaattcaaaggactgaagtgtcttcccagataggtaggagagaggcaagaacagctcagctgttaacaactgcgggtcacagctgtcaggagacatgccatggcagtggagagccccggctccaacccctggctggtccatggcccggctcagcagccttgaacttcacctgccctctttgggccacagttcactcatctgtccccaggaattatcagagctgttttgagatatcagaactggatgctaaaaagcctgatgttctcagtgcaaccctaaatagtcctgggattaatctgccccaggtgtgcacctcacaccaagcctgagggtcatttctggcacagggtgggggttgggggtagcagggcaaagcctggtgtctagcttcattcctccttccccaccccggagttctgcagggccccagatccagtgtttaacatattccctgtgagagtatgtacatgatgaccttattttccaggccagactagggagccctgaaaggcttccctttgtaaaattcagctcaacagccaggaatgcctcagtgtgtgaatgctagcactggccagtgcccctactgcttctcatggactttgaccaccatgcccacaggcaccctagccaagagatacatcctagctgcctccttctccttccttcatcttccgccaactctcaccacttctccttcctgagtagtccccatctccaccccagtgccagggaaaggattcggtcttctcccccctgggggagtctctctgtctggaatactctttgctttcttgctagtccctgcctactcattcagcagagtcagcccaggggtcagcttccactggctcccttcgtggccctccctcctctgtgcctgcagcccctgggcactcctccagaccagctcttattatgtggaattacacacagctcctccatggcctgtctgcgctgttgatgcgtgagaagggtttttctcctctttgactcatcaaagatttatagaccctctactgtgtgccaggaactgtttcaggccaggatgcactgatgaactggccagtgtccccactctcatggcacttccacaggggcgacaataaatgattcattcaatataatgccacatagccataactcttccaaaaaaaaagcaggacaaggaattggagggtgcctggaaggatagtgggtggcctaggaaggccactctggacaggggacatgaatagaggcatggagccctgtgcagatgtgtgggaagaacttcccagagaaggaagtgagtaaatacaatcacttgctctgcagtagcagctgccaatgtggctaggcagggttgtggaggtcagagaggtgagcaaagccaagtcaagctgggcctgtgggccacccagtatcatggggactcggcagaggaacaacgtgatctgatgtggggataaaggactgtaaagggagggagggagaactattgcagcatgaaaagacagtcgattgcactaaggggtggcaaagaaagtggggagaaggagacagacccatgaaatagtttaggaatggaaccagcaggatgcattgataatttagaaagtgaataaatcaacagtaactcctaggacttcagcttgaacaactagcgggatgacataaccatttaaaggttagagagatgaacaggtttggggtgttgggccctgtgaagcttcctgtgccctcagacatctagaggagatcacaggtaggcagtcagatgcacatggctgaggcccagtggtcagggctggggatgcacattccagagtcaaaggacaagggacttcaggaaacactgggagagagtgcagagagaagaagaaagagggccaaggacaggcctgaggtcagctcccacattcagatggcagcaaatgacactgagaagaaaggtctgcaggtggaagaaaacccagacacagagcccagggacatggaagctaagaggagggagcatttccaggacagatgggccatatgcagtgctgacccatatgtcttggaaatgggggtcaaagaagaggaggacagagaaggcaccactgatctagcaaccaggaagtcatcaatgaccttgacaagagcagattcaagggagaagggaacagatgcccctctgccgtaggtggaagcaaggccaggagtgggaaatgttggagatggtgccatggaagtctgcaggtgaaggagggctgagtgagtgtccgaagacctggtcctggggcaagtggagaggatgggatgtctcccaaagtgtaaagggatggctggaggaagaaaagagagacttcagtgttctgtgagcctccaaaaggcaagcctaagagccccagctgagacttagggaggaaaggtttacaatcagccagaggaagcacttcgaaccaggaggctcgcatggggaaggatggcctctttgggagcttcatgacctgctatcacttactagcttagcaaggtcttggtggccatcaagttgggggatgccgggctataaatggagacatgcagtggaaaactggaagagcctccagctgccttaaccttgtgagcatcccctaatctaatgggtgggtggatgcttggtccttccagcccgactccaactcccttttctttccttctttcccattctcatgccttcccctagcctcctgcctttgccaagtgattggcataaaattctcaaagatggtctacaagggaggaagcacaggatcgtgaagaaggagaagagggagaatgggtagtggaagctgaagggaggaacggagtctggggagttgacctgcagtgaagaaggggtgaggccctgacaggcactgcacccagctgatccggcctcctcagtttacaggaaagcagacaaggcccagggagggagtgctatccccccacggaagtgctgtgcgtctggggcgaacctaggcccactcagagaaccccaggagtgactgagcagggggggaagagaccccctcactccacctccacggagccctatggggacctgtgaggtgctttaaccttggagcactcagggagttacagagcctgtgacctcctttgtatcacccccagagttgggttaatgacctcagttttgcagatgaagtaattgaggcacagaaaggtttgtgtaagtggttatttgcccaggagactccacagagactcaaaagccataaagctttgggttcagagcactcctggagcaaccctgacttaaggaggaggagtctcccagtgccaacaactccacttccaccagcagcctcagccggccgcagcctgggttctgccaggccccaagaagcccacatcaggttcatgggaccaatgggggaagctgccaagtttgttttgctttttgtttctccagcatccagcccagaacattccaccaaacctgcatctccaaatccttcccagttgggtgaagctcaacagctctggccctttttccctccttttctgcagaagagaacattgacccggaaggctgaagtgagccagctgcacctgccacacaggagtgtgcttcctccgctgctctgccttcagcctggacgatggcattcgggactgcaggggtcgcactgcccccaagggctcctctttgaaatgtataattgccaggagcaggtggagggatgcatttttcagaggcaacaatcagaaaaacactaagcacacttgggaaggcaggagggaggaggacacagaagatagaaagtggaagagatagggaaggaggagatgagagaccctaaagatcatcttgtctgagatcaaccctgcagctttgacaacagttgcacagaagtgatctatttttttttttttttaattttttgagatacggtcttactctgtcacccaggctggagtacagtggcatgctctcagctcatagtggcatgatctcagctcactgcagcctcgaacttctgggctcaagtgatcttccgacctcagcctcctgagtagctaggactacaagcatgcaccaccatgtctagctatttttttttatttttatttttggtagagacgaggtcttgctatgtagaccaagctggtcttgaactcctagcctcaagcaatcctcccgcctcagcctcttacaagttctgggattataggcatgagcaactgtgcctgaccagaagtgatctacttaaatcaatatggcctttttattatggtctaacagcaaggagctgagggcagaaatagaagacctgaaaggacttggaaagaaaagacaaggaggctcacccagccctgcatgagctgtccacagcccagaaggaagaacccctctaacccctcccatgagtgctgggactgtggagtcacacaggatagatagatagatagatagatagatagatagatagatagatagatagatatagtgctccagctccacccaccacctggaagtgacctaatcttttggtgactaaatttcctcatctataaaatggagggtaatgaatacacccacctcaaatgtttgagggtaaggactgaatgggataatacatgtaaggcacccagtatagtgcctggccccagacactcacttggctcgctcttcagccaagaggaccctcttgtgtcatctatttggggcttgctcttttttcctgtagctggtgctaccctggccttgggaggtcttccacactccatcccagaagcccaggaagaagggtgcagggagaaggctgtcccacccacaggcagcctgggccagccccgctccggacctcagagacaagtgtctcctgagttgccttccacacctcctctttgccagcctgttccagaggtaagacccggagggccaagattggtgtggagtatggaaagggggccagtgaggccagccaaggagcctgcagctgtgcctggatctaggggatccagagggccctggagatgctcgcacaggtggtctagcccagtcctccaaagccagaggctcctcgggatttggggaatacctgagcaaacacagaaggattatgtgcactcgccagagggtcctctgtgtgtgcaatgacagaagttgccctgggggcagacgtatctacagaaggcagagttaaaggtgattcggttgggctggggctagcagggaaggcttcaaggaggaagtggatactggagggaggacaaggacctggatgtggagccagacccagttggcagaagctgagtgaagccctttgtgctgtggccatgggccaggctgacagtcagctctgctgggacagtgtctgggggactcctgcctcagctgtcctctgtccctgtgactgaagtgggggatgttttcctgaggcaatgcatgcaacactgcccaccctacaggacagaggccatcaccatgagggcaccgctgcctccccctgctctctgagcagttgctgggcagacaggcagctaggccagtccagagggaacagggttgcagctgaccatggaggacaagtaccctctatcctcctctgccttcccagaggggccatgctcggtgaggggtgttcaggaggaggtctagtcagttagcacaggagcacgtcatctgccttcactgccccgtctctacttttttttttagacggagttttgctcttgttgcccaggctggagtgcaatggcgtgatctcagctcaccacaacctctgcctcctgagttcaagcgattctcctgtctcagccgcccgagtagctgggattacagacatgtgccaccacgcctggctaattttgtatttttagtagagacggggcttctccaccctctctactttttatacctcacccccaccaactgtcagtcttccttttcccacccagaagcccacaaatgtcagcctgccctactatcagctcttttcaagagcgaattctctggcaattccagcctgtgaatgagtttctgattctaatgtgtttccagaaaggggacaacttttcaaagacagtgccaggagacaaggttgaatccaaagggataaatctctaagggaagactcaggaacactgaaatctaagttttctttcttaccaatagcctttactatttcctcgcttaattcattttttttttttacacaattcacatttattgagcacctactacataacaggtgccacgctaggttctggcaattcaaaacggaagatgcacaacaactgtcttactgagacgatggaagcacaaacacatgagaaatgtcttcacaggccttcctacttgtgcaaaacacccacttaaatagaaatatttgctgattgaaaattattccggctgggtgctgtggctcacgcctgtaatcccagcaccttgggaggctgaggcaggtggatcacttgaggtcaggagttcaagacaagcctggccaacacagtgaaaccccgtctctactaaaaattacaaaaattagccggcgctggtggcaggtgcctgtagtcccagctactcagtaggctgagggaggagaattgcttgaacccgggaggcgaaggttgcagtgaatcaagattgcatcactgcactccagcctgagcaatggagtgaaactctgtctcaaaaaaaaaaaaaaaagaaaaaaaattattcctatatgctcattaaatcagttcccctaaggatgcttattggacaacacttcatagacctagacttgaaattaataaagctatatgtcaatgtatatcttatagctcacacctttctaattcagcctgtacttccccagcctgtgaccaataagaagatctgaccacagccttttatgagcactatctggcttgaatttgctttgtagtgctgtttggagttttccggactaatcatttggactggctccttctgcctgtggctcctgcttgagtatatacaatgtatgagtcatttgcttctttgcccctcttcatcctctggttatatttggtacttcctgacttcctttccaaactgttaataataaataacaggttgtaccacacttcaacaccacacaactatagatagcaaaacatggcatgcactgaattattcaatatgtgaataataccatgaagctcatcccatcttccagatttggagagttgtcaattgggacaatgtacgtcgtgtcctcgttaggtcctcccccaagctctgcacagctgctgccaggagctgtcctgcccattttaaagaaggcagaagctgctcacacgccagggtaaaaactccagttccattctaactacgttaaccattatttcccacatgtggggactctacgtactgcagtccttcaactaggggggtacttcggggtcaactagaaatagagatttgaaattggaattgtcccaggaaaatgtgggaggtgtggtcatgccatttattctgtgactaaggaaattcttgctcaaatgggagcgctccagaaggaagtcaactcagctgctaacaatgttgcatcaaaggcacctgaattccaaaaccaacttgacagaggtcagctgtgtctctgaccctgcaggctcccggctgataggaaagaggaagctggcccagatcatggagagaggggcagagaaaataaagggcaagaggagtgagaaagggagtagggaagcaaggacgtggaggagagagggaggcaatggggaggaagaaaggaaggatggacaaaaacaggtaacaggaagaaaggcagaggagaacacaggtgcagtgagggctatgagaagttacaggtgaaaccgtggaaagaggaaggaaagacaaaagatactggcagcaggaaaagttaggaatggagcccatgcaatgacaatggtttcagccactgactggagacatctgccaagaaacagcttcccaggggcccgtcggtccgccttgctcacttgactcgcctttctatctttctctttcttttcttttttctttctttctttctttctttctctctttctttctctctttctctctcttctttccttcctttctttcttttctttctttctctcttctttccttttctttttctttctttctctctctcttctttccttcctttctctttctttctttctttctctctctctttcttttttttgacagggtttcactctgtcactcaggctggagtgcagtggcacaatctgagctcactgcagcctctgcctcccaggttcaagctattctcccgtctcagcctcctgagtagctgggattacaggcatgtgccaccacacccggctaatttttgcatttttagtagagatggggtttcaccatgttggccgggctggtctcaaactcctgacctcaagtgatccacccgccttggcctcccaaagtgctgggattacgggcatgagccaccatgcttggctttgactcgcattttctaccccaaacctcttgaagaactctcccaggagtccagtagggaggtacacacttgctgacttacctagactgctcaccacctgggaggcagggccgcttagcagacaggccagcatgggaggctcagcttcccaggacaagcatgggcccccaccttacccgtgatgtccagagctccctctgcacttccatggaaagaactgtggtcccaaaggccagcataagaccctccagcccaggccacagcgtgcgaccatccccacaccctcgggcatgtctgtggacatttgcttgactggtttctgacatcagaatctcatctttctcaaagcattgaataaaaacatacatatcaggggtccttgaaaaacccattacttctctgcagggtcaatttaatgtttgtgtgtcaaaatcaccagcaacaaaaatgcaagcctctctctcagggaaacggacgtgagagttaccccctccttaaaaatacaaaaattaagaaaccaaacagcttaatcagcccctgggaatgcttagctggcaggttccagtcatacccagctcccagcagagacagtatcctgcctcatctgcaaaaattctccacaataccctccctgcaatgagtgtgctcagcctgagaatattccatttttattcattcaacaaatattactgatcaagaggaaatagccacatgatggggcgcatagcaaatctcagcaccaccttgatggaaatggttctgctccagccaagggcaacctcccctgtgggcagggcagggagtacctgggcaagggacttcagagaagcagggaacacccacctgacacccgcttcttgatgccacccacccacacacacctacacacacttgctggctgatatccgaaatccctgcagcagggacagagctttggcccccacccctaaatggaggtttgagaccaagactccccaccctaccccctgatagaaggggccagtgaatccccgcttggttgtggttgggtcctatgcctcacccttcaaattcattcaccttcaagttaaaggaaccaggtgggataccaaagtgcagggagtttcgagccaccagaacaagacctgcttcttccaccctaggaagtggacaatgtggcaggggctgcagggccaccccgggttgagcttcccccactccctggccttttgccggggtctgtacctggagctggagtcactgccgctctgcactgctggatcatccgtgacattaaagagccccgtccaattggtcagctggtcaccactctgccaaccaaactggaggcctctggcaagaaaacgaggcagtcggtactcatgctcatttgctgggttaagcctgcctaccagagagccacattctgttgctgtgcccaagtgacacattgccttggtcatgcaattaaaggaggcgatggtactgactccaaccatgaggatggtgatcataaaccacagccctctacagtgctctctgcggttctgcatctatcccctcattccatctgtaccagcagggctgagagcacacatttcacacacagggacattgcgactttgcgagacaaaggtcgcagagctcttctacctcctataccgtgccatccctcaattcctgcctccagttaaaccaaaagagcgccagcaccacattttgtcctcctcaaaagccagacacacttcagagcttttaataaaatctacagtattccagcacacaaggataccacttttggttcaagacgtgcactcagcacatgcttatcttcactccttccccaaccctcactaaaatgacagcaaagggataaatacagacatgcatgtcgggagaaggccatagaaggggccagcaataacatgctggatgatgaaaagcacaaggtcatggacctccaccagacagtggacatcttacttcctgcaaaaagcagatctactcgcagtgaacaactcaggaaggctcaggaatgaaaggtccccagggccagcgaaggtgggagtgcacaatggagctaagagcagcattgtttgaagtctgcacaaaaagcagtcagacaaccctctccccaacgccctgtgaattcccataccaggccctcttcccaagcccaggcagcctggccactccacctgcccacctcacagatgtcaggagattgctttctggggaaaccgactcacaggagttctgcgctcttttctcttatcagagactctgcactgaaaacagtggatgtgcctgaaagtctgcttactgagtgcacctggcttctgaatgcttgggtcacacaccctgccttccaggtttgctgagggatgggtttctcaggagggaaactgatccgctcaaaagaaacagatatggaggaaagggttggtgcccgcttaattgccccagggcaggctttctcagcctggcactatggcatctggggttggctacttcattgttgtgggactgtcctgtgcattataggatgctgagcaacatccctgctctctaccaccagatgccagcagcattgtaccctggaccctcctgctgcagcaatcaaaaatgtctccagacattgccaatgtctactgggggcaaaattgccccagttgagaatcgctgtctataacaatccacagagcttccaagaaaccttctagtgactggctggcccttaaatataaacaagctattaagaccatcatcatgtgaagaaaactttaacagtcagagaacaaaacaaaacaaaataaaacagaacagctttctctgctcatgcccagtgtggtctcaatatgcagaacaatgccagtgagttcataaacctgtacctcccatggaaatgctccaccagcaaccattggtgccgaggaccatgggtccatgcaaaacgacatgggcgagattgacaaggttacgggcaggtttaacgaccagtttaaaacctatgttatccagagggccattcgcaggatgggtgagtcagattattccattctccgattggccaaagccaacagcatcgccccagaaagaacttttgactggacagaatcatggatgtggaatatttctctaaataaatagtgaggccaggcttgatggctcatgcctataatcccagcactttgggaggccgaggtgagtggatcacctgagctcaggagtttgagaccagattagacaacatggtgaaaccccatctctacaaaaaatacaaaaattagctgggcatggtggcacttgcctgtagtcccagctacttgggcggctaaggcgggagaatcccttgatcctgggaggtggaggttgaagtaagccgagatcacactactgcactctagcctgagcaagagagtgagaccctgtcttgaatgaatgaatgaatggatagatgaatgaataaatagtgaaacacttaaaaaaagaatgcagggggaaaaagacaaatgaaaaaagcagaaggccaagcgtagtggctcatgcctgtaatcccagcactttggaaggccgaggcaggcggactgcctgaggccaggagttcgagaccagcctggccagcatggtgaaaccctgtctctactaaaaatacaaaaattagccaggcatggtggcaggtgcctgtaatcccagctactcagaaggctgaggcatgagaatcgcttgaacctgggaggtgaaggttgcagtgagctgagatcgtgccattgcactccagcctgggtgacaagagcaaaactccatctaaaaaaaaaaaagaaaaaagcagaattttttttcaataaaacccttaataataaatagcctctaagctaagggaatggggcagcagatggtcactggagctgggaactgatccatccatatctccactaataggctgagtacctgagtctctgcacctctcaaggcctctgttcccatctttcaagaggactgtctcagttgccttcaaagtctttgactgcaagtatcacagatctgagccttcttctatgatgcccacgcacctccctcttcagaagtctagctcacctcctacgtgtgtgtcagcttagtctcccagccagaccctgggctgaggaggccccttggggccctgccagcagctctctgctgcacacatgaagtgctccagcgatgctttgctgagtaacagtagaccctgttctcatactctccaggctccacagcagtggggagctcagaggaaaaggtacaactcacagggcagaggccgaagccaaagcaaaatgcctgtccagttcttagtccattcaaaacacagaagggctccggtctggttctgattcaatagttattcatttatccatttatttatttattgaagtggttgtttcctttcaaagagatcaccaaggtatttcttggagaaaatttgggtttggtttattcagaagagagacactttgagcacctattatgaacccggccctttacataaatggtctcaattcctacaaacgcctcatgcagaaaatctcatgatcgggccaagcatggtggctcacacctgtaatcccagaattttgggaaaccgaggtgggtggatcacttgaggtcaggagttcgagaccagcctagccaacatggtgaaaccccatgtctactaaatatacaaaaattagctgggcatggtggtgcgtgcctgtaatcacagctactctgggaggctgaggcatgagaatcacttgaacccgggaggcagagattgcagtgaggagagatcatgccactgcactccagcctgggtgacagagcaagacgaaagaaaggaagaaagagagagaggaaggaaggaaggaaggaaggaaggaaggaaggaaggaaggaaggaaggaaggaaggaaaagagagaaagaaaggaaggaagaaagaaaatctcattatctccatttacagctgatgaaatatgcagcttagagaggtttagtagcttgcccaagtaacaagtagctaagctaagatttaaaccgagggctaactctaaatgcttctactcctaaaagtctttaccaaacagcctagaggccaagaaaacagtaatatttccacccgagattttgcaaactagttagttcacaaacatatcaaatcaatgtccagcccaggagtctgctacgaaactcatgggtccttaaaaaatagtctaaccagctagacttcttcccacagcatgcatgaagggtcagctagccagccacactgtcatcctcctacccatggtgagaccccatgtcccttcacatggcagtcccctcccaggactatagaagcgagggactactgagcagaaaatatgatgacttagcaagacactcattattaaatggcacgggtggggggggaacaagttacaaaaggagatacccaatagtagttccatttctgtaaggttttataccagaaagctggttacttttgtaggtggaattaaagtttattttttcttttagtttagcaatgtttactcatttacctcaaaaaaacctaactgcataattttcaaaaccaatgtattatataatttaaattccattcctgagctaaggataggatctattattagtcaaagaaacccaatgaggaaggcctgtggaggtataaaggaagatgacaaaatgaaaaaacatttcatggctgggcacagtggctcacgcctgtaatcccagcactttggtaggccatggtgggaggatcacttgaggtcaggagtttgagaccagcctgaccaacatggtgaaaccccatctctacttaaaaaaaaaaaaaatatatatatatatatatatatatatatatatatatatcctggatatatatatatatcctggatatatatatatatccaggaatggtggtgcacacctgtagtcccagctacttgggaggctgaggcaggagaattgcttgaacctgggaggcagaggctgcagtgagccgagattgtgccactgcactccagcctgggtgactgagtgagactctgtctcaaaaataataattaaataaaataaatttgtaaaaaaatttaaaaaataaaacattttattcactcattcatttatataacatttgttgagcatctactatgcattaggaactggtagttgctgggccaagtaacagcaaagagcaaacgcttgtttccaaaatgctcaccataaaattgagataattacactaacacacatagaaatattagcaaacaagatagggcaaaatcaagtgcttaaatggagtgctgtaactggttttttatgtctaatttattttttcaaaaagaaaagatttgaagtaaatacggcaggatgttaacatttgttaacactgctaattctcagtcatgactgcatgaatgtttgttatattgttctccatattcttttgtagtctataattccataataaaaatacacgttaaaataatttttaaggccaggcacggtggctcgtgcctgtaatcccatcactttgggaggccaaggagggtggatcacgaggtcaggagttcaagaccaacctggccaagatggtggatccccatctctactaaaaatacaaaaaaattagcccagtgtggtggcgcatgcctgtaatctcagctactcaggaggctgaggcagagtattgcttgaacccaggaggcggaggttgcagtgagtcaagatcacaccactgcactgagcaaacagagcgagactccatctcaaaaaacaaacaaacaaacaacaacaacaaaaaacaagtgcttaactgtgctaaactcgtaatcactaacaaggccttagagtagccaagggcagcttcctggactcagtcagccttgcagaatctttgcaccttgcaggttaagctagaattgaacacagccctgaacctaaggaaacagaacatataagaattatgtaaactgatttattcaagactggattcagatatttagaggcctcaagcactgaaaagtgtgtggtgccacctcacgcccatacttactcaaaagttatgtgcctgttaaaataaaaatagctctgtctggattttctgattataaaatctgggatatgtttatggaggctcagcttttctctgttgtgtggttattgctgacaacctggctcagccaggtccctggttgtgtaacccacagccatgtaacatagccccttgctctcatggcaatgaatcctacagccatcagaggatggggaaagctgcccatgcttccctgagccaactaccaggggaatttcaggacagaaggcaaaatcacatctcagagaagcaatttaaaaacaggtggaactacctccattaataataccctccaaatattgtaaggcattatcttattaaaatttttgccaatggattaaaatatatatatgttccaggcactgtgacagatttacatgttatttcaaatcctcccaaaagcctataggtgggcattagtatcaccatttcacagatgaggaaactgaacctagggagattagatttacaacctgcccagatattgtgaagagcagagaaagtattcaagcccaagcccggcgtcagggcccatgtttcttccttctctcctttaaccccatgttctcatgctcttttttggggaaaaaaagacttttccattgtccaatatttttaatattatttgagctgctgccattgctgtggactgtttaatgacgaagtctatataaaacaaaccatgcatgggtgtggtggctcacgcctgtaagcattttgggaggccgaggcaggaggatcacaaggtcaagggatcgagaccatcctggccaacatggtgaaaccccatctctactaaaaatacagaaattagctgggtatggaggcatgagcctgtagtcccagctactcaggaggctgaggcaggagaatcgcttgaacccaggaggcagaggttgcagtgagctgagatcacaccactgcactccagcctggtgatagagcgagactccatctcaaaaaaaaaaaaaaaactatagagtattataaaatgaagaggctgaacaaaatcatctctgagatcctttcccattttgattgaagtgccaaagttacagaatttctggcactggaggaggccagtggaggcaattttgtgggggacacaggaaggggaggaagtggcacatgcgtagctatccattcacagtgtgtgggctcctgcacaatctgccttcgcatatggtaggcctggggccaagcatccgcgagtgcccactcagatgctggaatctccagggtggttgaaccaaaagaggctgaatctatggggcacagggcatttggcactgtggacttaggttccccaaagaagccccacccctgatgccagagcccaggaccccatgtgctgactgctcaacccagtggggcacagcgtgcagcccaggtcaccaagagactggccatgtgctcaagacaaaatgcaactgaacccatccttgcaaaccacctccaagagcctcctgcttcaggctgaggcccccccacatgctctggagagtgagactgaagccactgtcattgctctgctctgtttttcaggtcagtagaggacaggaaggcagctgcttcctagatggtctcctaggtcttcatgccttccctgtccaacggcctgaacactgccatcagagtgagcttcctaaggagtatcccaatagcaccacttgcctattccagaaccttccaagactgcccacgacccaaaggacaggatcagaccctcaactcagtgccccaggagtggccctgcagtttcacttgcacccctctgcaaacctcagctttttaagccactattgtgctcccacaatcatcctgcgccccacctgcctcaatgtccctcaacctccaacgtccagctcaagcaccaccacttccctgaggcccttcttgaccactctggcccagcccaccaggccgtcccaccttggaactaagtcagcacttactctccaaccccctacaccttctcatcctgcctcactcagcggtcacctctgcctgtctatctgtgagttctgtcacccctacataattatggtccttcctagggaagaaactagactttatatctaaaactgagccccaaattgtctttctcaaagtccttaagcaaccagagtggggaaagggggccaggggtgggtgccttgaactccaccctccccagaggtctccttaggaaaattggaacaggagggtcttaccagtcctgggaaagaggaagaaacagagagaggggaggccagccagaaacacatgccagactgcttgttgagtccaaccctcctggggcaggcaaagggactgcagccatagaggtgttagaggtgttgccaggcaaactcccacccaagagacaagttttacagtggataatccagagctagtaaggggcaccaggcagggaggggtatgacttgaaggcccacaggggctgtcccctgtccctaaagtatcttacccattaacctgtcactaagactccaaaagaatgacagtgttgcgaccaacaattacaaacggacttcttcagtgttaggagatactgctgctgccctcaagaactgacagtccggttttaactgttatttgggaaatgaccaccttgcacaggtggggtcctcggaagagtccagaggttagggggtggtgagaggacagaaaatgcagtgaactggaggaggccaggccagggttctactaagaactgcagcactaatcccagaaattgttagttctcagtgaggggcaaatagctccaatgctaaacagcctttggcaggatttcaggcagaagtgccagtttgatgagggagaaggttctggataagaaggtgttatcagtgcctctccatcagtcacaaacctgcagctgccatgttcctttaaaggtgttaacaccagccccagaagtggccactttcttcagagcttcaatagccatccaagcagatgactcacctccaggcaatgcttgcctctagagattcttggataggggggctcgcattccaccattcactagcagtgtgactctcagcattgaacctcttgaagtctcagttttctcatccgtcaaaggggatgaataatcctcaacctaaggatataaacagtctacaaaagcagacatataaatgctaacatgcatataaaggcttttatatctaatatacacaattaaaatgtatttaacccaatgtttgcataaagaaaagataatggagtggttgatggacaaggtgagaagtcttcctttccatttgtacacacttttgtaacttttgattttatacatgcttgcattactttttcaaaaaataaacaaaagtaggcctggcactttgggaggccaaggcagggggatagcttgagctcaggagtttgagaccagcctaggcaacatagtgagaacctgtctctatcaaaaaatcaaaaaattagagcttaggaggctgcgtcaggaaaatcatttgagcacaggaggttgaggctgcaattagtcatgatcacaccactgcactctagcctgggtgacagggcaagatgctgtctcaaaaaataaaaataaaggaaataagcaaaagtaggctgggcacaggagctaatacctgtaattccagtgctttgggaggctgaagtgggaggattgcctgagacccagagttaaaggctgcactgagctatgattgtgctactgcactacagcctggatgacagagcaacaacaccctgcgtctaaaaaagaaaaaagaaacaacaacacagatggtcaccccaactaccaggtgaagtgaagatgaactatgtgtgacaaatggctctgtcaactacgtgagcgctagttgtttatccggagaagatgcaggtagcgggctgtagctgcctggttatgtcaagggggagatttctttctgtctttgcagtctcttagcagattgcctgtgatgagcactacgttctgatttaatgcttattcaatagtaaaaacattttatttctctaccaaaagaaaaagaaaaaggccttttggtaactcttttggcgttgcacaaacaggagggatggtagcgacgatgatggctggtattaacacaaaaatgaaaaataaggaaaacaaaacaagggcagttgtttcatgctgagaatgtcatgtctttctcctgagtaactgctactacccatacccctcggggaactagaggtcactgagcaccgggctcagggccccttcacctccctctcgccccagcaggagagcccaggcccctgtggagggcgaggactccaaggatcagtagccagagtggctgcagccactgatctgaaagtccttcctgacccaagtcttgaccaagaacaaagccaaatccacttcttctccttaaaacaactcaatcttaagccagcagccaccccagaacagacgcccttaccttcctgacggatcccatcctggccaggggagggccctgctcatcctatgaccatcatctctaaagttagggatggcaccataacatgcacactttcgctcaagaagctctccttagagagctcctctatgctcttcttggaccttttagagcatcacgcaccctgggtaaaacagccaataaaagtacaaccgcacattaatcatttatatttctacaaagtgcttcacttctaccagggagcaaattcaaacctgggcatgaggggcccagacagagaacgagcagagcgaaggcaacaagaacaggggagggtgtctgtgctgcccaagttgtgggaagacaggcctcgggttgccactttgctcatttgtccaagaggggcaggaagtccaggcttttatttttcatttcccagttcttaaaggttgccaatgaatccaaacttgaaacactgtgcagaccaaatacgacacgctgtaggctgcagaccacccattggcagcccctgagttgcagcatcttgctccatcctgaccccagtcctgtgagggagagaggtagagtgcaccatcagccatcacagctgaggaaacaggcatagagtgggaagttagctcaagccacctgggggcaaagataggcctggaacccaggagtcctgactcccagttcaggcctctcagcacccaaggtctggatcctgtcccgggagtcagttgcacccagcacacattggggtcttcccatattggggtgctgggtcagtgacctcagccttctggcctcatgcacaacacacctgttcacctttactgctatcctcacactggcccaggtgagcgcattccagggccctgcctgtcaccaccccctccctcttgacaggcatacaacaggaatgagaatgactgtactccctatcattagagggataaccttgagtaggctctattcgtaaaaaaacaataaaagaagaaaatcattcacaaacgttgctatttaacttttgtgggaggataatctattgaattattcatttgtattttccctcctccattccagaaaggtagctcggttttcttatcttcaacccagggccaactgggttgtgggggcgaaaggcttcaatgctcaagaaattgtgctgtgaagaaactgtgtgagagagtcctgggggaggtggggggccagtgcctctgggtctcgggagggctggtggaagtggtgagaccatggcccaaaccaggaagcccatgctagcagcttgagatcgctctgtccacatccctcacaagggatagcaggacctcagaaaggggcagctcgggaggctggacccagggctccagaagcctccagaaagcagtgagcagatcagcagggccagcacagcccagggggtccacggcactgttctgtcccacacaagacccccagggtcttcacacaaccctgggagggggaagaccccgaaggcggctcaacactggtggattcaacttcccacaaattggtgggtaaggtttagtcatgtttttaatgaaagaaagtttaaaaatgagccatttctttcacaccaagccaagcttgtgaaataaaatgtataattgcttttctattgttaatcagcaaatcacttgcattggacctcacagtgtatcgagggtacctttccttttcccattcattctattttcatcttgttatatatgcataatatttattttatgatattattctatattggtccaacagccatcccaggccacatactgaggctcaacagcgagcaagccaccaaagccttgccccagtgactcttaatttctaccagagggagacagatatgacgacaataaactaacaggcgacaaaatgcgtcatacgctaaagggtgaaaggtgttgtgggagaaataaagggaggaaagggggataaggggcttggggtgggggaggaatgttattccacacagggcagtcagggaggcctctctgggaaggggacatgtgagcaggacaggaagtgggtgatgaggggccagcccaggtggatgcgctaggtgaggactgtcccctgcagaggcagaggtgaggggaggatgagctttcactggggccaagtgagccaggggcagggtggccagtgatggggcatcagttcatggaagaaaggaacactgcctttctggggtccctcaaagccatgtgagaggaaggtgagtccaatttcatctctggaggagccaagaactcagccaggagtctctgtgggctgggcccagaatgtaggcttctccccgtccctagggggctctgaccgcccttcccccacctacctcccgaagccctccaccatccccaggtccaggtaaggagatgggcccctcagagaaggtgccaggaccttcccacccagattagagcggagatgcttctggttgcgccgcattctcagcaggatgaacgggcgcaatgaccaggttctgcgctcccttgcctgtccatgctcctgactcactctgtgacttacgttactttcctacgaagctccagaggataacaattccctcatcagaaaaaggaaggggtttcattcaccagggtccacctggggggcctttcattggaggcaaaagaaaagatgctgcagggcaggagtatctggagggaggagaggaacggagagacccccaacccctaggccgttccccacctccccccacccctgctctccaccctggcagtacacctggggttgcctctctaatcttttgggcagaaatttcactcttccttttccaggctccactcaaagcctaaatcttgtccagtggttcccaaattgactccgtggaacactgggtcaccctttgagcctctgcagaggagaggagggaaaatggtggaggtagggtttaggacaagggaactaggtaggcaggactggagcccccatcctgtttcaagcagagcatccttccttctaaggtgagcatgggctcctacacagcccttagccagaggggtctctctgccttctgactccagcagcaatgaacaagagtttgcactatccacttggcacttagtatataagatagttgtaaactcttcatgtgtgtttgagccttccctgccctaccccaagagagcaccctgtttcatccatcttggtaaatgtgatggttaactttaagtgtcaacttgattagattgaaggatgcaaaatactgttcctgagtgtgtctgtgagagtgttgccaaaggagattaacatttcagtcagtggactgggagaggcagacccacccttaatgtgggtaggcaccatctaatcaactgccaatgtggctagaataaagcagacttactgagtctcctggccttcatctttctccatgctggatgcttcctgccctggaaaatcggactccaagttcttcaacttttggactcttggacttaacaccagtgtttgccacgagctctcaggccttcggccacagactgaggactgctctgctggcttccctacttttgaggtttggggacttggactggcttccttgctcctcagcttgtagatggcctattgtgggacttcgctttgtgatcatgtgagtcaatactccttaataaactgccctttatatatacatctatcctattagttctgtgcctctagagaaccctgactaatacagtaaccaacgtctatagcagcaccaatagaaatataccaggagtcacatatataattttaaattttctggtagccacattataaaaaagtaaaaattcatgtaataaaattgcttagaactaaatacacagacttataaataagtgcatgcaaaattggtgaaatgagaattgatggattgtatcaatgtgaatttcctggttctgatattgtactatattgtttggggtgttttagtttttgagacagggtcttgccctgttgcccaggctggaatgtagcagtgctgtcatagctgactgcagcatcaacttcctgggtccaagcaatcctcccacctcagcctcctgagtagccaggactacaggcatgcaccaccacacctggataatttttttttttttcgtacagacagggtatcactctgctgcccaggctagtctcaaattcccggggtcaagtgatcctcccactttggcctcccaaagtgctaggattacagacatgagccaccatgtctggacatgatattgtactatattgttttgaaagatgttatctttggaggaaattaggggaagtggatacaggttctctctgtgttgttacagctgcgtatgaatctacaattctcaaaaagatttttttaaagtaaaaagaaacaggtaaaattcatttcaataatatacttattctaacctaatatattcaaatattatcatttcaacacacaaacaatataaaaaaattaaggagatacgtcacatcccttttttgtattatgtcttcgaaatccaacgtgtattgtatatgtacagacagcatgtctcaactcagacgcaacacttccagtgctcagtagtcacatggggctagtggctagtggacagtgcagggctagtacacaaagggcacacaatggatgctttctgcatgaatgatgaatgaaccaattaaccaacctgaactaagaggggcctgagattggacctgcagaatagcacctcaccagcagaagtgcaccgggtgggggtaggggcacatagatgtggggatattggctctgcaggcactgctgggtggaaagagaaccccctaaaatgaacttggattagaaggaggacaaaaacccagcctaacatggaaggaagagaaagcacttgggaattcttgcttcctttaaaccttcttttgggggttgtggggtgtggtttatttccaagaaatggcaatggtggtcttaggaagtattgatcctttgatctgctgaggaagaatggggagttggcaggttggaggagtgaggggagggaggtttggccttcctttgcccagatactcggcaaatgcagcacaaaatcagatggaataccaggctggagtgagcgtggatgcattttattctcccaggacaccccccgctgacccagtgtggcattaaacccccagaacccccacagtgtggcatcccatacacatatcctggcttacctgccttatttccattccctccacccacacagtccaggggctctgcaggacctgtgggccccctggaaggagccagcaaagcccagcctgagctgttctcctgagggaccagtcccttgtgccccacgtcaccagagctggaagagaggaagccaccttgcccacccactcacactgcatgaggctaaacagagaccagacaggccgtcagtcagcttcacagagctatggtgtctaaaaagaaactttcaaatctttgatagcttccatcacctgctcctcctgcctcaacacctcagcctgtcccccagatatccccaaatccagtctctgagacccaccagttcttcaaagcctctgtcaggtcccaccagggtactcccaccccgccccattgctgtctcctctgaaacctacaagatttatagtctatgccacaaaattgcgagtttatttatacactgtcttacataatttttcatgtttgtctctttaagtgttctgtaagtttcttaaggacatgaatcataccaaataattctttagtagcatcccctctcccccagcgcaaagctgagagggcgtttaacgaatgtttcttgattgttaggataaagtttcaggattcccttcgtatgaatccatccattcaacaattagtgtcaggcactgtgctaggacctgagaacttagagatgaataaagcatctcttacaagggtcttaccagctgtgtgactttacacatgttacttcccctctctgcaagaatatgaaatgaggaagactatgtatttaataggactatggagaggattaaatgaaataatcttcatttaggattagcttcttaggttagaacctgcctcatgatcccttagtgaatgttaataattaattttttttttttgagacagagtctcactgtgtcgcccaggctggagtgcagtggtgcaatcttggctcactgcaacctctacctcccaggttcaagcgattctcctgcctcagcctcctgaggagctggaattacaggcatgcaccaccacgcccgaataatttttgtatttttagtagagataggatttcaccacgttggccaggctggtctcaaactcctgacctcaggtaatctgcccacctcggcctctcaaaatgctgggattacagacatgagacaacactcctggccaatagttaatattattacctcatgaatccttcacctgtggggaggaggggtgtccctagggtaataggtagggttaagagctaaattagagaattattagataagaagtgaatgacctggatacatcaaaaagaagaaattaaattctctaagaggtaaatccctggaaaatagaaatgtcaaaaaaaaaaaaaaggtgggtggggcaaggaagaagagacggaatccgggagtaagagggtatcactgtgctcctgagagatatctgaggaaggtacaggaaactcacatccaacacctggtgcagggctgggcatatggcaggtcagagccaggattagaggaaggccagcaaggcacccagcacacaacatttaaagaggtcctcattctcaggctcatgtaagtacaaagttaacgcctgagagtagaggccaccttaaattttgttccctggatcacttgctggcctcacctcatctcagttttgcagcaagtgctcaggagaaacttgctctgaccagcgaaactgtaaagtcactctgctgacccaccacacacccaggctgcagtcagagcagcatcccttctttccagggcaccctccccctcgagaaccacactctggatagatcctccagtccctgtggtcccaatctcctggggctgtgcctgtttctcggggcagtcgaacagaaggctttgtcccctgggtcgggggagagttggctcagtgatgagggccttcgaatatacacatgtaggcagcacaaagtcaggctgtacttttccttgacccagtttcgcatcctcaagtctcaggcctgcactagccacatgcaggcagcccagctttttgccctgaaggtgcaggagagaggaaggctggagggaagacaaagcataggagggtcctctgtacttgaggcaggacaaaactcctggtctcatttcctgtccactgcacaatcacatagaaaagcaatgggacagtgctgagcaggatgtgctaagtagagacaccatggtgctgtgaattcagaggagagaaagaacaccgtgggctgagaccagaaagagaagcaggatttggactgaaagacagctgggaggggacagcgggtcggaggcagcgtgggtgaaggcccagagttaggacagatgtgacatgcgtaaaagacccttcactggccgggtgtggtggctcatgcctgtaatcccagcactttgggaggctgaggcgggtggatcacctgaggtcagaagttcaagaccagcctggccaacatagcgaaaccccgactctactaaaaatacaaaaattaaattggcatgagcctgtaatcccagctactcaggaagctaaggcaggagaattgcttgaacccgggaggcggaggttgcagtgagctgagatagcgccactgcactccagcatgggtaacagagcgagactccacctcgaaaaaaatagatccttggctgacaggggagaaacattcaacttccagagtgggcttcagcacagactgacaattaggcatgagatttttgtttggggaacagagacattcaaagatttctatttccaacaaagtggccaactgagaagccctctggggcaggtgctgtgacataccccaccacatcaccttcgggaatgaaggacttctccccacctgttgggggtgccatgagccgacagccctcagctctcattcctctttgagaattgccacaggtgagcagagccaccttgctcaaggttatgtcctcttccagggcatatacctcttccaggtataaaggtcaggccccctcaccccaactctgggcaagtatgaagagacagcccagctccagggctgcctatggggtccactgaggctttctctggaactgtattgcagctcaatttctccctatggccagtcatatttccttctctctttctcagatattgatcccaagaacacttctcaataaacatcctacactctaatctctgactcagagtctactttccagggaatccaatctgcaacatcctcccaataaaaaacactaaaataacaattaaaatgtcttttaattgccttattaaattgatgaatagtctggcaagaaaagaagtagtagatgcattcgtcagccaatctcggtgattcatgcttcccttgtaatggccaaagggccctcccaaggagggtcacactgggaacctcctcctaaagccaagaaagcacaaataatgcaaaagagaagaagggagaaaaggcaaggtatgtgaaacacacaaaatatgatggcagaaataaatccttagtcatcagtaatcacaataaatgtaaatatactaaactttctaagtagaagacagagattgtcagactaggtattaaaaactgtaagtatgtgctagttacaacagacatagaatgaaagacatgcaaatttaaaaaaaaagattcaatatcataaatatcatgttctctcaccacaatacctttgagttaaaaaaatcaaaaagataaggaaaaacttgaagcctctggacattttaaagcacttctaacttcatgagtgagtaaattatgatagaaattagaaaataattggaattcaagatattgaaaatacatctggtatttactagctgtatgaccttgaacaaattacttaacctcactgtggctcagtttcctcatctataaaatagcccctggtaacagtatctattacttgtgttatatggattcagtatgttaacacataaagcacatggactagtaactggcacatcgtaaatgcaatgtcgttctgagttcttgttatcatcatcatccccaaattgaagagatttaattaaagaaatatttagaggaaattttataacttcaaaagtttacattagaaaatagaaagactgttaactgaagagctaagcacccaacttaggaagttagaaaaatgacagaataaaatcaaagcataaaaattaataaaatagaaagcaaatatccaagagaaaatcaacaatgccaaaatctgatcattttacagagacaatgtaaaaaacagaaaaagaaacaagtaaataatgttaagaattaaaaaggggcaaaccgatggatatgacagagatgaaatacagcatattataaattttgccaataaacttgatttcttttaatttctagaaaaatataatttaccaaaattgattgaagaaatagaaaacttaaatactcttacaattactaaagaaatggatcagtaacttgattaataagtcttaattagtaagacttaatggattagtaaagttttcccatatggaaaacattaggtgcagatggttgtagaggtgaggtctaccaaacatttaaagaatagatgaatctcaaaaacgtgcataagtcattacagagaataaagttttaacattctcaactcatttgcaagactgattttaaaaccaggcaaagatagcatgataagagaaaattacatccaatagcattcaagaaacagaacagatcatcctgaataaaaataatagcaaacaaaatctcacatcatataaaacaaataatataccataaacaagctgggtttacccctaaaattataagttgaacatctattaaagtaattgaccacatcaaaaggttaaaggggaaaaactacacaccattcaatagatgtagaaaaagtacttataaaattaatatctaaatacaatttttggctggatgcagtggctcacacctgtaatcccagcactttgggaggctaaggaggatggatcacctgaggtcaggggttccagaccagcctgagcaacatcgtgaaatcccctctctactaaaaatacaaaaattagctgggcatggtggcgcatgcctgtaatcccagcttctcgggaggctgaggcatgagaatcacttgaacccaggaggtggaggttgcagtgagccgagatcaagccactgcatccagcctgggtgccagagcgacgctccatgtaaaaaataaataaataaataaatataattttcaaaataagaaaaaacaaaacttttaacacattctacaaatgtgtggaactttacctattagaaaatatcttaaaaaaataagcaaacatattcaatgatgacacttttttaacattccctttacaattaggattaatcataccatatacaaaaattaactcaaaatgggtcaaagatctcaatgtcagagctaaaactgtataatacttagaaaaatgtttaagtgtaaatttttgtgatgttggattaggcaatggttccttagatatgacacctaaagcacaagcaatcaacaacaaaaaaaaaatagcagaattggacttcataaaaatgtaaaacttttgtgcttcaaaggaacaccaaaaaagtgaaaagacatgttttgcaaatcacgtacctgataagcgacttatacttgaaatatataaagaactcttacaactcaagaagaaaaagtaaaataatccactttaaaaataggcaaagggacctctgtgggcagggcatagctgaacaaaaggcagcagaaacttctgcagacttaaacgtccctgtctgacagctctgaagagagcagtggttctcccagcatggtctttgatctctgagaacagacagactgcctcctcaagggggtccctgacccccgtatagcctaactgggagacacctcccagtagggactgacagacacctcatacaggcggatgcccctctgggacgaaactttcaaagaaaggatcaggcagcaatatttgctgttctgcagcctccgctggtgatacccaggcaaacagggtctggagtggacctccaggaaactccaatagacctgcaggtgagggacctgttagaaggaaaactaacaaacagaaagaaatagcatcaacatcaacaaaaaggacatctacaccaaaacgccatttgtaggtcaccaacaaaccaaaagtagataaaaccacaaagatggggagaagccagagcagaaaagctgaaaattctaaaaaccagggtgcctcttcccctccaaaggatcacagctcctcgccagcaatggaacaaagctggacagagaatgactttgatgagttgacagaagaaggcttcagaaggttggtaataacaaacttctccgagctaaaggaacatgttctaacccatcacaaggaagttaaaaaccttgaaaaaaggttacaggaatggctaaactagaataaacagtgtagagaagaccttaaatgacctgatggagctgaaaactatggtacaagaacttcgtgatgcatgcacaagcttcaatagccgattcgatcaagtggaagaaaaggtatcagtgattgaagatcaaattaatgaaataaagcaagaagacaagtttagagaaaaaagagtaaaaagaagtgaacaaagcctccaagaaatatgggactatgtgaaaagaccaaatctacattcgattggtgtacctgaaagtgagggggagaatggaaccaagatgggaaacagtcttcaggatattatccaggagaacttccccaacctagcaaggcaggccaaacttcaaattcaggaaatacagagaacaccaaaaagatactccttgagaagagcaaccccaagacacataattgtcagattcaccaaagttgaaatgaaggaaaaaaggttaagggcagccagagagaaaggtcgggttacccacaaagggaagcccatcaactaacagcggatctctcagcagaaaccctacaagccagaagagagtgggggccaatattcaacattcttaaagaaaagaattttcaacccagaatttcatatccagccaaactaagcttcataactgaaggagaaataaaatcttttacagacaagcaaatgctgagagactttgtcaccagcaggcctgccttacaagagctcctgaaggaagcattgaacatggaaaggaacaaccggtaccagccactgcaaaaacatgccaaattgtaaaaaccatcgatgctatgaagaaactgcatcaattaacgggcaaaataaccacctaacatcataatgacgggatcaaattcacacataacaatattaaccttaagtgtaaatggactaaatgctccaattaaaagatatagactggcaatttggataaagagtcaagacccatcagtgtgctgtattcaggagacccatctcatgtgcagagacatacataggctcaaaataaagggatggaggaagatctaccaagcaaatggaaagcaaaataaagcaggggttgcaatcctaggctctgataaaacagactttaagccaacaaagatcaaaagagacaacgaaggtcatttcataatggtaaagggatcaattcaacgagaagagctaactatcctaaatagatatgcacccaatacaagagcacccagattcataaagcaagtccttagatacctacaaagagacttagactcccacacaataataatgggagattttcacaccccactgtcaatattagacagatcaacaagacagaagtttaacaaggatatccaggacttgaactcagctctgcaccaagaagacctaacagacatctacagaactctccaccctaaatcaacagaatatacattcttctcagcaccacatcgcacttattctaaaattgaccacatagttggaagtaaagcactcctcagcaaatgtaaaagaacagaaatcacaacaaactgtctctcagaccacagtgcaatcaaattagaactcaggattaagaaactcactcaaaactgcacaactacatggaaactgaacaacctgctcctgaatgactactgggtaaataacgaaatgaaagcagaaataaagatgttctttgaaaccaatgagaacaaagacacaacataccagaatctctgggacacatttaaagcagtgtatagagggaaatttatagcactaaatgcccacaagagaaagcaggaaagatctaaaattgacaccctaacatcacaattcaaagaactagagaagcaagagcaaatacattcaaaagctagcagaaggcaagaaataactaagatcaaagcagaactgaaggagatagagacacaaaaaacccttcaaaaaatcaacaaatccaggagctggttttttgaaacgatcaacaaaattgatagaccgctagcaaaaccaataaagaaaaaaaagagagaagaatcaaatagatgcaataaaaaatgataaaggggatatcaccaccaatcccacagaaatacaaactatcatcagagaatactataaacacctctacgcaaataaactagaaaacctagtagaaatgaataaattcctggacgcatacaccctcccaagactaaaccaggaagaagttgaatctctgaatagaccaataacaggttctgatattgaggcaataattaatagcctaccaaccaaaaaaagtccaggaccaaacggattcacagccaaattctaccagaggtacaaagaggagctggtaccattccttctgaaactattccaatcaatagaaaaagagggactcctccttaactcattttatgaggccagaatcatcctgatactaaagcctggcagagacacaaccaaaaagagaattttagaccaatatccctgataaacatcgatgcaaaagtcctcaataaaatactggcaaatcgaatccagcagcacatcaaaaagcttatccaccacgatcaagtgggcttcatccctgggatgcaaggctggttcaacatatgcaaatcaataaacgtaatccatcacataaacagaaccaacgacaaaaaacacatgattatctcaatggatgcagaaaagtccttcaacaaaattcaacagctcttcatgctaaaaactctcaataaactaggtgttgaaggaacgtatctcaaaataataagagctatttatgacaaacccacagccagtatcatactgaatgggcaaaaactgggagcattccctttgaaaactcacacaagaaaatgatgtcctctctcaccactcctattcaacatagtgttggaagttctggccagggcattcaggcaagagaaagaaataaagggtattcaattaggaaaagaggaaatcaaattgtcccggtttgcagatgacatgatcgtatatttagaaaaccccattatctcagcccaaaatctccttaagctgataagcaacttcagcaaagtctcaggatacaaaatcaatctgcaaaaatcacaagcattcctatacacaaataacagacaaacagagagccaaatcatgagtgaactcccatccacaattgctacaaagagaataaaatacctaggaatccaacttacaagggatgtgaaggacctcttcaaggagaactacaaaccactgctcagtgaaataaaagaggacacaaacaaaatggaagaacattctatgctcatggataggaagaatcaatatcatgaaaatggccatactgcccaaggtaatttacagattcaatgccatccccatcaagctaccaatgactttcgtcacagaattggaaaaaactactttaaagtccatatggaaccaaaaaagagcccacattgccaagacaatcctaagcaaaaaaaaacaaagctggagacaccacgctacctgacttcaaactatattacaaggctacagtaaccaaaacagcatagtactggtatcaaaacagatatataaaccaatgtaacagaacagaggcctcagaaataacaccacacatctacaaccatctgatctttgacaaacctgacaaaaacaagaaatcgggaaaggattccctgtttaataaatggtgctgggaaaactggctagccatatgtagaaaactgaaactggatcccttccttacacattatataaaaattaattcaagacggattaaagacttaaatgttagacctaaaaccataaaacccctagaagaaaacctaggcaataccattcaggacataggcctgggcaaggacttcatgactaaaacaccaaaagcaatggcaacaaaagccaaaatagacaaatggtatctaattaaactaaagagcttctgcatggcaaaataaactaccatcagagtgaacaagcaacctacagaatgggagaaaatttttgccatctacccatctgacaaagggttaatatccagaatctacaaagaatttaaacaaatttacaagaaaaaaacaaacaaccccacctaaaagtgggcaaaggatatgaacagacacttcttaaaagaagacatttatgcagccaacagaaacatgaaaaaatgctcatcatcactggtcatcagagaaatccagatcaaaaccacaatgagataccatctcacaccagttagaacggtgatcattaaaaagtcaggaaacaacagatgctggagaggatgtagagaaataggaacacttttacactgttggtgggagtgtaaattagttcaatgattgtggaagacagtgtggtggttcctcaaggatccagaactagaaataccatttgacccagccatcccattactgggtatatacccaaaggattataaatcatgctactataaagactcatgcacacatatgtttgttgcggcactattcacagtaccaaagacttggaaccaacccaaatgtccatcaatgatagactggattaagaaattgtggcacatatataccatggaatactatgtagccataaaaaaggatgagttcatgtcctttgcagggacgtggatgaagctggaaaccatcattctaagcaaactatcacaaggacagaaaaccaaacactgcatgttctcactcataggtgggaactgaacaatgagaacacttggacacagggtggggaacatcacacaccggggcctgtcagggggtggagggctgggggagggatagcattaggagaaatatctaatgtaaataatgaattgatgggtgcagcaaaccaacatggcacatgtatacatatgtaacaaacctgcacgttgtgcacatgtaccctagaactcaaaagtataattcataaataaataaattaattaatttaaaaaaataggcaaaggggctgggcgtggtggctggctgggcgtggtggctcattcctgtaatcccagcactttgggaggctgggaagggtggatcacctgagattaggagttcgagactagtctggccaacatggtgaaaccctgtctctaataaaaatacaaaaattagccaggcatgatggtatatacctgtaatcccagctactcaggaggctgaggtgggagaatcacttgaaaccgggaggcagaggttgcactgagctgagatcgcaccattgcactccagcctgggcaaaacttcctctcaaaaaaaaaaaaaaaaaaaaggcaaagaatctaaatagatatttctccaaagaagatatgcaaatagctaacaagcacattaaaagatgctccacatcattagtcatcagagaaatgcaaaatcaaaaccacagtgagatgtcacctcaaaaccactgagatggctataatccaaaaaaaaagataataaaagtgttatcaaggatgtagacaaattggaaccctcatacaatgctggagaaaatgtaaaatgatacagccaccttggagaaccctggcagttcatcaaatggcaaacacagagttaccatataaccagttctactcacaggtataaacccaagagaaatgaaaatctatatccacacaaaaacttaacataacagtgaaaaacaactcaaatgtctatgagttgaagaacagagaaacagaatgcagtctatccatacaatgaaatattattctgcaataagaataaatgaagtactgatacatgatatgacatggatgaaccttgaaaacattctgcttagtgaaagatgtcaatcacataggacaacatagcatatgattccatttatatgaaatgctcaaaacgggaaaatctagggagacagaaaacaggttagtgcgtttgctcattcctaggactaggagggataggggtctgggaagcgatggctaaggggtacaggatttcttttgcagagtaatgaaaatgtcctaaaattgactgtggtggtagatgtgcaactgtatgaatatattaaaagccatttaactctacactttaagtgggtaaattttatttcaataaagctgtcaaaaaaagaaagaagaaaacgatgaggactaaaatgaggatgttcactccgacacttttattgaatattatgtcaaaggtcctagccactacagtaaaacaagaaccatatattaaggtataatggtagtaatgaaagaaagaaaaatgtctacatagaaatccccagataatcttcagataaactattatcagtatgtgcataatcaaggttgctgattataaaattaatacacaaaaaacaaatttatttctatatgccagctacgaatggttagaaaatataactttttaaaagataatttgtacgataataaacattttacatagtttttaaatagttaaaaactatatagctagacatgaattgttacggactaaataattgtttgtgtccccccaaaattcctatgttgaaatcgaatcccaaggcaatggtatttagaggtggaggcttggggggatgattaggtcagagagtggagcagtcacaaatgggattggtgcccacataagacgaggccagagacttagctacctctctttcatccccacatgaggaaacaagaagtctacaacctgcaggagggccctcaccagaacccaaccatgctatcaccttgatcttgaactttcagcctcttgagcaggagaaacaaacatttgttgcttaagctaccaaatctatggtaatttgttatagcagcccaaacaaactaagatgtaaatctaacagaaaacattcaaactctttatggagaattataaaactccattgaaagacacgggaagacattcaaggcccaaggttatttggttttcctgagattaagtttaaaagatagactcagaccagattattaaaatctaccatgtcttttttcctacctttaaataaacattgccctttccctgtccctctgttaaagtgtaaacacctgaagttgtaatactctagggctgtgagcttatatgaagatttcagcactaacaaaggggattggggtcagtgggggacttaaaagaagacggaacaatttccatgcccctcattgtggaaaatctttcttttaatgctttttcttctcagcattgacacctagaaagggtaacctgcgctccctgtctccacattgtctttccccactcactccctgcccactgaaataggatcctgtccccacttctctctcccaaactgtctttgcctctactgccaacccagcagacacctcaatcctatcccacccgagccctcttcctggcatgccacagttggccactctcactctgacgccctcgtcccttggtttccttaacacctccctctcctcattcccctccacctctctccagcctcggcttccagagccagctctcctctctcgaccccttataggtgcagacatccttcaaggctctcctttgtgcccagacccatcatcattttccactctgctctgtccttggtgactcatccaatcccattgctcacatcagtggttttctaactgagggtttcaacccaacggattgtaaaatttaatgggttgctctcagatttttttaataaaaactctttttattgtggcaaaatacacaataacataaaatttaccattttaaccatttttaagtctacagttgaatgtcattaagttcattcacattgctgtgctaccatcaccaccatccatctccaatactttctcatctttccaaactgaaactccatacccattaaaagatgactccccatcccacacccagcccccaggaaccaccattctactttctgtctttatgaatttgacaactctaggtctctcatatcattggaatcatagagtatttgtcctcttgtgcctggctgatttcacttaacacaaggtctccaaggttcatccatgttgtagcacatttcagaacttcctttctttttaaggccaatattccattgtattttttaaggaagtagaatggatttatttatttatttatttatttaatttttaaattttatttatttattttttgagacagagtctcgctctgtcacccaggctggagtgcaatggtgcgatcttggctcactgcaacctccacctcccagtttcaagcaattcttgtgcctcagcctcctgagtagctgggattacaggtgtgtgccaccacacctggctaatttttgtatttttagtagagacagggtttcaccatgttggtcaagctggtctcgaacccctgacctcatgatccaccagcctaggcctcccaaagtgctgggattacaggtatgagccaccgcacatggcaaatggattttttaaatgaagtaaaatagaaaacattagagtacatttctcgtaataaggccaagtattgcttcacaaaatgtttcagttgagtgtgtacataactgtgttcaaggtctccggctataacatatgccatactgtgcttcccaatcataaaagtttgaaaaacactgatgtcagtggttggtgactccaaatctacattactagtctggctcttcccaacgcagttctgggtagctccacgcacgaggatccagacccacagctgtcaccctccccgctccctcccagacacgccatcctcacagggtccctactttcttctcaggaattgggccctgcctgcctcactctgtccccagcaatatagctctaacccctgagtcatgcagattcactcaactcttgcctgcacttgtcaatccttgctcaaactcggtttcatcccccttcctttcacttctgcctatgcctgtggatcattcccctttcttgaagaccccttcaaatgcctccatgtaccttgaaacacagtgattttctctggcgcctcctccttgtttttagagtccctcgtccattcctctaggcgtgcctttctgtcttcccaatagccaccggctccctggagaccctggactgtgcctgccttgcacaccattgtatccctagcacttaaagagtaaatctgcatgaagtatttgttcaatcaatcaaaacagacatggagaagccaagagcatcaaggagtacgttcacaactttgtttcttgtctttttctcctcattcacatagcacatgctttctccattagagacactgagcccactaagccacctgcactgccccaccttctcccctcctgaccaagggaggtgctgcaaatggacccccagagttctgactgctctcaatggggtcctcccaaaagctctggttgcagagcacagggagagcccagggtccaaagaagtaagcacacatcgactcacagccccactgccatttgctctgggctgtcgctaaattctccctggaagagcctgcctttgctgtgtccctgaaatctttgtgaggtggcatcgcaccagctcagcacagaagcaaagaatggcagccttcaggaatcccctggctctgaagtggacctgctccctgcaacaagttcttctcactttcactgggctgtgacagtacctcccagcctctctacctctttaacccttcctgtaggagacccagctaacatccttcttaggggcttttatcctgccattaccctactccagggccaaacacagctcccaatggcccaatgaaccaaatgcaaattgttcttctcaatcttcaaaacactttgctgaggctagtgacccactgttacatctgccctcttcgtcccttccttccacctcacagcagttgtatccatttcttcattgtgtctcttcctgttacaatccctgcgcgcacacacatagtcctaccttcaattatttattcattatccaatatttattgagaacatcttatgtgctggacaccaagtttggtgttcacagtgcagctgggaacaaaacagagcaaattggttgggcgcagtggctcatgcctgtaatcccagcactttggaaggccgaggcgggcggatcacaaggtcaggagatcaagaccatcctggctaacaggctgaaaacccgtctctactaaaaatacaaaaaattagctgggtgtggtggcaggccactgtagtcccagctacttgccaaggctgaggcaggagaatggcctgaacccgggaggcagagtttgcagtgagctgagatcgcgccacggcactccagcctgggtgacacagtgagactccatctcagaaaaaaaaaaaaaagaaagaaaaagaaaaaagagcaaatccccactgcatggagctttcggtctagagcagtttctcaacctcagcactactgacatttggggctggaaaattatttgttgctgggggcaaactatgcattataggtctttacaacctctttggcctcttccctctgcatgcagcagcactctcctctccccagtgtgaatgccacagaagtctccaaacattgccacggggaataggggattgagaaccactggtctagagcagcaggaggagcttgttgcagcttgcagatcgcctggggagcttgttacaaaggcaggttagtagatctcacccgaagacagtcagattcaggggctcaggagtctgcatttcaatggtcctccagttggttctgattcaggccctcccagagcctctgcttgaagaacactggtcaagtgtttgtagacaggagacagactgatgataatcacatcaggccagttcattacaatcatgatatatggaggaaacaagataggtaagcaggtgctaggggtgacactgatgtgacagccacatccagttcaagatcaggactaaccaatgattaagccaagtgctgcagtgtaggtagggtcaggtgtgggagagacgggaggaaattgtgacacacttgcatctctgcacctttgctcctgcccactttttggatgtgcatgccccctgcccccaccctcaaatcttacccttccttcaaggcccactcaagttcaacttcctctgggcacagtcttgcctaacttctccagcctatcagtgcttctcttctcagacagtttaacattcactttctgtttcatttgtggctattttgttgccccaaatagacttcgagtcctctgagtaccaagaccacatcatctccttctttacagacccttatctacaggcacgcttccaggatcagccctatacaagttttgcctggttgattgggttgagtctctagagtgaggcctgcaagatagcatctatgcgattcagggggtcagggtctctgtgagggaggaagggaagcaccttgtgtgcctgctgaactcctggcagctagcccacccacccaagaccagggaggacttgccagagcaagcaggtagtttggttggcgtttgccatgggcggttgtattttccccctgttgacaaggcagaaggaatcccagcagccccagcaactttggggaggtgccgggagggggcaggaacccagagctgccctgctgaagagcaagtgccaagacagcagcaggcaatcggcctgcagggccgcagcaagctgtgggggacccagctgtccttgcataggatcatctcaggggcagcagtagccaaaacaagaggcaggcccaatcagatccaagaagccaggagactccgaagatggcctttaaagccaccagtgtcagacagcactcaggagctgccaccaaccagggaacgctccctgggaaggtccggagcagcaactggctgtaaacaaatgttcagaacaaggtgcctcattactccccagctccgggggagttacaaggaggggaaacagcctaagtgctcggcttttccactggacagcgacacctagcagcgatcctcaccctcccaccttcgtgggcagcccagattgggagcacccatacctgatgtatccacctcacccaaaggatgagaagagggctgtttcgttatggggaagtttagagaagaaggtgggatgcttacttagctagagagacatttattttcctatcaacctaggggaggggcggtgagagtagggagacactagcagcaaactaaaaaacagcccagcagctaggagagagggctcttgccaagagaggctctgatatgggtgtatcctagagcaagaacctcccctaatctctcaaaccaggcggaggaaccccaagtgtttccttaagccagcagagccggcagaaggaagtggctggcatttcagtgtatcttctgcaaatagagaggctgaggctgtgcccgaattgaatttctgagtgacacctcctactgctctttctcttggagtttaaccgtggattggggtggagtagggggagagcccaacgaggggttaacttatgctgcagctctgaccttttgcgctaaggatgagaaaaaaaaagccatctgtttcagaaggaatcaggttgttgagtttcacagatccagtggctgtgggattgtaagacttcactatcactatccctgtcgcatagccacagcccacactaccacccccaccgaacccgaagctcctggaggggaaaatgctttttctcccaagggtccttacgaaagttcaggactcgcgaggttataaacaaacaaacaaacaaacaaacaatcgatacgattttgagccctccgaccccggagtccaaacaaatggccatagaactgtgggtctggaggacaccgctccgatccatgcggtctctccgggtattaaatggatttatcgtcagcctggttgcttggaattctattctgtccttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggccgaggggtccgcgtagcgcatcctggctaccgggcgccgcgggcgcggggtacggggcggccaggcaatgactcgcggggttccggggccccggggggcgcgcggccgacttggcgcctcacggtgcggtcaggcaggcgggggacttcgaggggcaaagtttctggttggcgcggccggagctgggggcatccaagcgtcgcaggcgctggggcggcaagcaggacagggccggtggcagggagctctgccgcggccaggggccttccccacccccgggtacctttacctccaggcgccggtgccgggtagccgccgatttccccgcggaggggagacgccaggtgccacgagccggaggcggcccctcccgccgaggtggcggccaatggggagcaagacccgggctccgtcccctgtgcgccccagcgcgccgcgcatcgacccctccagtccggcgccggatcgcggttgcccagcgcgctgtgccctgccgggggcgggccacgtttgatctccgggcccgcagcaagggatcgcgaaggttggcctccggttctgccgatagggacggggggagggggcgtacaaaacacccgcgcagtctggctaatgataggcgggccgtggggagggggaggggcggagcgcaaaacgccgggtttgaatcttggaattaaaaagagggcaggggctgggcgcggtggctcactcctgtaatcccagcactttgggaggccgaggcgggcggatcacaaggtcaggagttcaagaccagcctggccaatatggcgaaaacccgtatctactaaaaatacaaaaaacaaaattagccaggcgtggtggcacgcgcctgtagtcccagctacttgggagactgaggcagaagaatcgcttgaacctgggaggcggaggttgcagtgagccgggatcgcgccactgcactccagcctgggcgacagagcgagactccgtctcaaaaagaaaaaaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaaggacggcgcgccgctcctgcatgctgatggcctgcggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagccggcagccttcggggaccacagtccccccaaagctttaggaagccagttactacatccggaaagattcgtgcttcagaacgcaagccagggagaataatcacagaaacgcaatgcgaatgtcgtgcctctcagaaattcttagcctgaaataccgtccccaccccccaacccggccaggcgacagtcctgtcatcctaacaccgcagaggctccaagcgctgggagtcgtgtgcccgcggcgctcgccactgaggccggttggaagattctagggtgccccttcccaggttccagcaggcactccgggatgttctagagtcaggccagggattcaacagcgaacctgaccgaaactcaaacctcagcacaagaactttgatgggggaagtgcccagactccaatactctcgaccttggcatttagtagtttcttctttgaactggaaagatcaaataatgcacagtaaaatctcatgataagggttccaccaagaattcgggatttgtgttaattcataaggcagaagtggcccctgtgctatccatgaagagtttctgtatttctctgcaaggtcacaggtaggctttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccacaggtaggctttttaaccaattaaagaaaaactccaacatttagagggcccattattataataattcctgtatttgtttgctgtctggcacataaaaacgtgcttcacttgcatatattaatgaattttcacctcctagcccctggctaacccattttacagctgaaaggactaaagcaacagatgcccaaagtaactcacctagcaacaagtcttgggattctgagatgaggttctttctcccacacacacaggcaggctggcttcttgggagtgggacttgttcatttgtccccaccaccaccattgattttgactgattgctccactcttgctgtcttcaaacttttgaacaagggggtttgcatttctctttgcactgggccaaattatgaggtaggtcctacacacaggctccaagatgacagtactaatttttcactaatttttctctacttggtgctcaagtgtagagtttgaggggtactatcatcttcactccaggcaaggcactgttgtttcttttgtattcctgcttattctccaccccatcaggtgctcactctgatacctgtctttgagtgctgttttcttggaaaaacaaatctattttcaagaaatgaatcaaaattatcctaagaactttttaattgcaatataatgcatttacagaaaagtacacaaatcataaatgttcaggtcgctgtgttttcacaagctgaacacacccatgtaaccagtacacagatcaattatcggcccccaggagtcccctcatgttcctatctggttactatgtactcaagagtaaccactgttctgaatcctaaccccaaagatcagtgcttcctgttttgtgttttatataaatgcaattatacattatatattattttgtgtctgccttcttttgcttaacgttgctatgagatttatccatgctgttgcatgtggtgggcagaattacaagaagacccccaagattcctcaccccttcttgtatgcacattcccataggtattgatctaggcgctgctgtgaagggaatttgcagatgtaattggcctaaatcagttggctttaatatcaggaaattgtcctcagtgggcatggccatatggagcccttacaagggactgggctcttcctggtgaaaaagatttgaatcacgagagtggctgatatgagggaaattctttgctgttgccttcgaagacagaagaggtccacaaggcaaaggatgcagacagcctgtaggagctgagactggctcctggctgacagccagcaaggaaatgaggacctcagtcctccaatcatgaagcagactccgacttctgctaacaacctgaatacacttcaaagaggattctgagctccagccgcctacacattgatttcagctgttgggaccctcagccgagaacccagctatgccgtgcccagatgtaagacctacacatctgtgagcttgtaagtgtgtgttgctttaagccactaagtttgtggtaatatgtttcactgcaatatgaaactaatacttctgtgtgcagttatagtttgttcaatcttattgctatatagtatgccatcaaacgactgtggcacaacttatccattctacagctgatggacatctgggtagttgctgccatcagccttccagtgcatggttttttgggtgaaaacatgcatgcatatctgctgggtatctatttctagaagtaaaattgctaggtcagagagtatacatatgttcagctttagcaattactgccaaagtttttccaaagggaaaattatttttaataggtattttatccagatttgccacgacctaataaggaattcgtccccacaataaaactaactggctaacctaatagcaaaaagcccacccaatcaagagccaagatagttgagggacaacaacagctccaaaggcacccactctcccttgaggaggtactcaacagttaggtctcctgcatgaattggcagtgaatgagattgatgctggcattaggaatagctagaactttgcagcaagactctatgtagaatagattttggtcacttgatcctctgcacatgatcagcaatagtccagtggtctctgctgacactgctcttctaatcctaatggcattttaattctgactatcttcatatcagaggtatctttaacacacacacaaacacctcacaggcatctctagtgaagctggagacctaagatctcaaaacatggaggtctgaagtcccttttgttcctatcagtatggagctagattccattttaagccaaatttatattctgattgtagaattgcagcaaacactcagaaggccttgcaaacaaaagagtaaacacatggataaatgatcactatgccagattcagtgaacaccatttttatattctaattgccaggaatggggacagctgcatcattgtttaaaacacacactcatgcacaattaagccagaacaaatgtcaacactggcaccatctgctaaattactgataactgatgagcattactcatgctgtgagcattgtctccaatataaaatggaaagactttttcaaaaacttagaggtttctaccagttttaaaaagccagtttttatatcatacagcacaactgcaacctgtcagattatgtaagtgacatttcacccatgtgttcgaggagtatgtgataagtacatgctgtttttgtgcctctttacatttatgttaacaagccaggccttcaagaggctgattcctggctctgggacactttgtctgtgatgagggtatcttgctgtcaggtgagcagaaatgcccagttataaccttgtaatcagagagccagggttttgccattacatggtcaactgcagacacaagactctacttcatcagtctcgtttttaataaattatataacagaaaaatgatttaaaccccttgttcagtccccttatgaagtacaaattgtatccaatataatttatgaaaaatcatttataatcttgaacctggagatgaagccacctttcagctttcatatctccaagctgagaagcatcctcctgcctgtctcagcatcactcccagatattcttctcctgcatttgttccaatttatccagtttgtttcaaagggtagagatattattattagtaatccataaaccacctgatgcatcatagtacagaaagattctcttgcacctcaggcatgtcacactcctacagtatgttcctgtacttgccagaaacagcatcactggaataaggtcactcagatcacattcagatgacatgctggacataatggacctagaatctccttttcttaccttaaaggctgggctgtagggtagaaacacttggatcaggttctgccctttgatgaattcagctaagagaatgtattttttaatttccaagccagtgcaagcccctagacgcattttgttggtggtctgtataatgctgagactttcagaggaatgccctataaatacagctgcttaaaaatgtttaatattccttgggtacctgagaagagaaaagggatgagtgttccactgtgatcatctacttctgaagcaccaagggatgtttcaaatcctaacaccatggccacagtaaagcatgtgtcatttaaccaccatcctaaattctaaaagctccatgcattgggtagacatggctagtatggacactatgtgctagacattgtatgacatgctagggaaacgagaatcagtcattcacagtctgtgcctagaaaggagtttaaattcccatgaggaagacagacagtgccctatagtaggattaagatctgtctaacccaaattgggagtgacagagaggtcagtgggcagggggcagaatggcaaggaaggtttccagaggaggtagtgtttgacctgaattgtgatgcgtgaggacgttcagccaggtaaagaggtgggacaaggtactgtaggtggaggctggcagtgggtgatggggtacagttggctcaacacggctgaagagattaggctgggtgggtgagtgcgagacagagcacagagaattgggattttatccatgaaaccattgcaagattttaagtaggggaatgatatgatcagatttgcattttagataatcaagctgcaggctagtggagcacagtttgagggttcaaagactgaaaaggcacggagatgccggcttgtctttcttttccctgatcagaccagaccccttcccttggcctccccttcccaccacatacctcattggcaggcagccctactatgagctcatattattgtaccaatttgagaattaattatctgcctccttccagggtagcaggaaaagagtagagaaacatgattactgactgctttatagaagctgtcaccatattaagtgcttcatcattcaattcacctgagatgcatggaaataggttaagcttgattgaggctggtccaccgcaaaactgtgcagttagcagagtttgtttttggtacatatacccttttgttactctgcagccccctctgctctataggttcctggtataataacactctcttcccctcccttttggaacctctgctcttgggaaaggctttgatagctttctcttaaatactagtgttcctgatgggagaaatttaacctgaagcatcctctctgactgcaatgaaggtgttgtcctgttagaactgcactcagagcactgtaaagaattatataagtagccatcaccttaaccacatcctcaaacattttcaatgcaatctagcggagaatgattttctgaaagaatacatatctgattttataacagaaataaatggaaatatgatttgttttatagaaaatgtcttgccctctaactattaatatgtcaatatttatatatgaactacaataagaacagctacaacaagattgatgtatactgcctgaacgccctgaaaatagatcattgtccgcaagtgtagttaccaatataacagcctagtcttgctgtgctatgagtttgcctggattgccattacttataggccaagtagactgtggtgaatgccagatactagccaactttttctgaaagagccagatgataaatatcataaactttgtggcccagacaggttctgttgcaactcccaactctgccactgtagtgtgaaaacatagacaatggagaacgaatgtgaatggccagagttgctccacaggattgctaactcctgctccacactttgtgatatgcagatcccatgcaagaagtcccacctcatttccctgaagagtcaccataaaaggcattccatgtttagacatcatatttacaaaggcctaataaataataacatgttaatctattatccaccatcaacatgttagcacagttttatttatccttgaagtgaacctggagatcacaggatgacctttctatgcatacactctcctctaactttgaccagcggtctcataaatacacgtcccaggtcaccatggacaactaaacaaatatatgggttgcttggtgagatttcacctccacttatgaagacaataaattcttgtgtcctaaaagtcagtgtgtcagttaaggtcttttcacgaaagtaacaggaaccatagagaaattcattatctcacatatcaggaaatctagaggaggggtgggctccacaattggctgatcagtgtcctatgactccagctcctttccatcctttgctctaccatctacaatataggcttctgcctaagaggagctgtcctcatggtcagggatagaggccagctgtaactgggacaatagcaggagagtggagagaggagaggagaggggaggggaggggagggaagattctcctccagcctgagaccaataataatcaccagagggatccatgtagtgattggcttatgcctgggttcctgaaccaatcactgacaagggtatgatagctcatagttggcttagttggctaagagccatccccaggagctgggatcaagtccagaaccacattgctgctacctggatggagaggcaatggatgttggagtcaacccgcatgtcctctatgatccagagtggcactttcttctacttattttcccctttcttcctttcaatggaacacggttgctgtgattaagagtagtgttgatggcagaaaaacaagaggatggtgagatgtcctcctccaacttcccagaaatgttgtttcagaaccatatgtagaattgtggcagtctcctgcccatccccccaactctctctctctcttctctctctctttctctctctctctctctttactggtgctagcacctatgactacaatcatgaagcccataggaaaagcaagaagccaggcaacaggtcagccaacttacaagtgtgaaaacagattatgtttgttgcctaaataccttggtgttcacctgcaaggaggtgagaaggctgaagaaagtggctggcaatgtcctagaatgtgagaggtgctgtaggatgggagaaagagctcagaatggggtgtcaggaggagacatgctttatgtcacaactctgtgagctcaggaaaggcacttaacatccctaatgcactggtcttctcacctgtaaactggaaaaataatacctatccctcaaagtaggagtttgtgagggtcaaagtaaaaatgtaggggcattttgaaaacagtgaagctatacagtcctaaggtaaacagcattatttactatgacattagataggggaggaaatttcataaatgctgagtctcaacaaatttgtgaatttggtcaggtatcttcggtggtctccttttcctcgcctcaacacttgactagtccaagtacccaggactgtctgctgaccatgactgtccccactgaagcccagaccaggatctgccccctacactctctgctcaccaagactcacctgttcggagtctcactatctcatctccttaatgcaggtctgaaactaatactaaggaagcctgggattgtggaaagggcacaagcccaagagtcagaaacctgaatcctaggtctggctctgccactaactggctgtctgaattcaggcttcattaacctatcggcaaccttggattttcagcctataaaataaaaaagagctacagtttctaaaactttctaacactaaaatgctggcctcaaaccctgactctgtgaccttcctcttgccctcattccccttctcataaatggtagctctgagggcaccgtcacagaatgcaagggcttgctacagcaaagtttgaaaacaactgggccaaatggtcccccaagttctcattcatcttgaaaatgttctaacttagtctctcattctaagagaaatggcttcatgctaatgtgagatgcgatgatatagtacctctacctagaatcacctgtatttgagtaggaatcctcatagctgtataatcttattagttaatatataaagatggaatttcgggtaccatgtatgtcaaagaggtagttgggagactccctgggtttcctaaaatcataccacttgggttatccactgatcatatagggcttaattgcttgaggtggtgaatggcattttcaggatggtgaatgacctcctggtttcccaatactgggcacatcaatgagtaggttcctatcagatccttggttgaccatgtggcccaaggaggtcaaggaaaggcttttatgtctttcatggggcgtgcatgagctagaatcaggttcagctttgaaggacagaaatctccaaaatgacaagagttaatataaagatacatatgtgttgttgttttttctttaccatgtgacagatgttcaggggtaagcaatccaaggctggcagagaggctccatttaaaaagtctttgacaatccaggcctttttaactcactactctaatatcccaaagatgtatccctgtgctcatgttccagggtggacactaaagctctagccatcacatccaaggtccttcagtgggataatttaggaatcagagagactgaggggttgaggaggatacttattatttattatttaggtgcaccggcccagtcagattaacatctaaaggactgagcccggaacaaagagtcaggttaccttttaagcatttcttggggttgggggagatctgtgcagggggaagtatgttacagaagtgagaaacaaagacagttattcaattgagacatgcattatattatttcttacttttcaaggaaaaacatgtatgacttgagtttatctgcctagtgaccttgcagctgcacagctagagaaacagggtcttcacaatgcctagaaagggagagataaggctcactagccatagacagaaaaacaggcagttaatttttaaaggactccacctctttctcttcctcagggggaatgaggttttttacatacaactgagtttttgcttacacatttttaaatttcttttaatgcctgtttcagtctagttaacaagatggaggaagagataaagaaggacattccccaaagtctcacagaactcttctgctcacatctcattggctaacatgagtcacatggtgaacctggatgcagggaggctgaagaagacagtcatcttgctgggcagaaggaaaggaaggaggacctatgaacagtggtgggttccatgtcaggggcttgccagccacaaggaaaggtcagaaattcccagaatttcagttctgaaatctgtatgttgacccagactcttgggaattttacctggatattttcagattcttaaacataatttttaatgtcatttgaatggatgcagaggagagctgtataagtaattgagtatgaactttaaaaatacattaggattcaaaactgcatgctacaaaatcaccatctttttaaccttttcaaaaaggtgtaacatatgtacagaaaagtgctcaaatcataacatacagctctccataaattatcacagagtgaagacacccatgtcattaccactaagaaaaaaagagagaaaccatcacaccccagaacccaccctgtgctcctcccagcctcatgtgcccatccggaatgttttccttttctctgcttttctcctcaagtctgtcttagccccctcttctcttctggccacctcacttcccaggcctccccgataccccgggcagtggggggcttttttgaggctggtttgccttttggcacagtggaaatagcatgtgctctggagccagctctccaagatctagatctcagcccacctactcactagctttgtgaatccaagcaagagacctaatccctctcagctccccaggcactatcctggggtcacaggtgctgattgggtacttcccagagtggctaccgagtgcctgctgctcagcatggggctcaaatacacccactgcattttcatttctatgcttttgcttgggtctctgaaagctcccgagggatgttcattgtttccatttcacagattgccacaatgatgcctgcagaggtgaaatgacttgcccagcatcacacagtggggcaagggcagagtgaagcctggaccctaggctctgaggccacagcagcacaggacccggagctgtgccctccggccccagacctgccatggtcctgtggctgtttagacgactgtttggcccaggggtgcctggctctctaaaagattcactgttgccctcaccaatatttatttcagccttcccagaatgtttcctaaacagacacacgaatgccaactttatgacacttgctaataaaaataaaccccctcagtaggactgggttcccgtggtgcctaataatagctacaggcgtgaatgagtaaatagctggccacacaaagtgtgtgggaccctccagggccagacagaatgtgtagcagttagtgccaaaggcagcgtctgcacccagggcctggggccagtgatgggacacctggcaggacaaggagagcaggccccatcctggccacaaaggcaaagctgaggcagtccatgccatcaaccaacaagtactacaggacagtgaccctagtgcaggtgctgggtaatatgtgggcatgtggagtttggaggttcagaggaaaactcctcacctttcccaagatgttcagacatttatttagaagggaccgagcctttccttacattggaaacacaagactaccatgcaaataatcctaggagaggaggccaagggcctgtccagagtaacgtacagaagtcagagccttccttgacagggactttggctacgggaagagaggcacagcctgtggtctctcctggtccactctgagcctcccctcattgtctgtcctcaccatgttccaccctgtccctgctcctcaggttctccaaagctctgaaaagcaacaacagctacaacaacagcatcactgggttcttgttgggtgctaggcactgttgtaagtgcctccctggtgttagtgcatttggtcttcatgatcttatgaggtaggaactattatgatgcccatacacatgaggaaactgaggcacaaaaggttaagtaactgtccaaggtgacacagccaggaggatgtggaaatgggacccgaacccaggctgtctgctcccagagcccacccttcttttgcttccatcaaaatcatcagtgcagggtgctggttccctagactcctgccgactcttccaagccctcagaaccccagggccagaggcagggtcggtgcactcctggggaccagatctctgctctttcactccctgtcaaggctctggtcgcccagctgcaccatgccattccttgccctggcctgtatcctcaatgtctggtacaacttgcccgtctttccctccacctcacctcctgcccccattctagggatttggacatctatccagagctgtggccagcagccagcctcgcaggcctccacctcctctgaccttgcttgctgcccgctttcccgtccactgggcagtccccagggaggtacagggcagaggagctggtgtgttaagagctcgggctctggaatcacactgctggggttccaatgccaacccagaccattgccagttttgtcccctcagataggtttcttgacctctgtgagcctcagtttccctatttatgagataggccaataaaaaagaaacaactaccttcacagttataccaggagtgagattaggcctgccaattacttcaaagggagctggctgcataggaagtatttgggaaatattagcacttactatgaccccatctagtcaaacaagtctgaaatcataaaatcagatattccactttctaaccacaacttcctgttctccacttttcaagaccttctacccccactagctactgtgctgtattagtagcccaagggctgggtccccattctccagtattcttgccatctcctggtttctcatcctttctcctttgctaagaccccacggtcaatcactcaacttactttcttataatacccatggttccctcacatgtggtctgtttctattaggattaggttcagccgggtgcggtggctcacgcctgtaatcccagcactttgggaggccaaggcgggcggatcacgaggtcaggatatcaagaccatcctggccaacacagtgaaaccctgtctctactaaaaatacaaaaaaattagctgggcgcggtggcaggcgcctgtagtcccagctattcgggaggctgaggcaggaaaatggcgtgaacccgggaggcggagcttgcagtgaggcgacatcatgccactgcactccagcctgggcgacagagccagactccgtctcaaaaaaaaaaaaaaggattaggttcatgacatatgacagaaaacccaaaataacagttcttaaaatcatgagtgtttatttctctctcaaattaaagaaatccagaggtggttagcccagagataacatagagactctatgtgcctgaggaacccttgctcctcctctctcgctgtttgcccattcttagaacactgtcttgtagtccaagatggctgcttgagctcctgccatgatgtccacattccagacagcaggaggaggaagcaagaagaaggaagaacaaaatggagtgcccccacagtctatccttcttttcaggagcctttccatcccgtgccttcctctcatatatccttggcaagaactcagttccatagccacacctagttgctgcttacttgctgtcccaaataaaaggagaaaaggggaaggttggttctactgctgtacctgcttcctggccaatccacagtcagtgatgacttcgtcatccacttctgcttccaagctgtccccactactggagaaaataacataattgagctgacaggcagctctgcagactcctggcttccagcccaaccaagccccccacactcctagaaaaagccattttcctctcttttgcatgccacatggcaattattccaagtattcaatcactttcctgaatcgctcttcccaccccttgctcttggcaggcagtcttgcctccatcctccctctcatcagccttcagacatccctttcattcctctgaagctgctccagctccacccagggggtgacttcctccctggcaagagtgggccttctcttccccctgaaccacacggtgagacttagcacagagctgaacatacaatcaacagaaacaaactgatgagagctgaggtgtgaataactaaacagcttaatctatacactctcccacgataatctgcttttaaccagagccttcggtgctccactccaaaggaggcacctcggggaatcaaagggcccaagcagactaacttggggttatttcagggacagtggtcccctgcccctagcagccctcaaaccttcacagcagcagatggacctccaaatgcagaacagttccccctgaaaaaagcccagaatcatgtgacaccatcacccctgctcctctgtgacttcagccagtccccatgctcaggccctactagcacatgagcaccgggcatactgtccacctccaaaaagaggaaaaatgactcaggagagaatgccagtattgtcccatgttaaaaagaaagtgtccatattcttacagaaagcatctcctttgcaaccaggctgctttgctaggaacagcctgagtacggatgtcttgggtttagggactgactgaggtcagccacaccatccttcagtaaagggaggagaagcagaagccagagaagagctgggattctcagcccaccaaacctcgtctgcacaaagcctccaattcctgccacacttggggaacctggaggactggggtgggggactcttttctagggactcacattggctctcagggccctggccccctccatcctcctctgctcccactgagctaatgagggactgggtcaggaaattgctcaggaactaaagggttcctacttagtgtgaaaagtcaaacttagaggttgctataaaaaggagcaaaaataacagatgtgcctcttcatctgtctttatgttccctgtttcatttatcacacacatcttgcaatagctactcattttcacattttcctcagtcacttcctccctccaacgtgaattacttaaaataaccaccaccacttggggtcagcctcacagccatgcatagcaggcagcggctccaggacaaggactgagcccagaagaagcttcaggtgaggcttcatcaccgtcctactgactctcaagactcttaacagtagtcagaggtggcgctgtgtgaggaggccccaggaccctactgggatgacactggtaactccgaggacaagcttggctaggagagcaagagagagcacaggccatatggcatgaaaagaacatgtgaccagagacaggacctggatttttggttcagtttacactgtcagcatgctgtgtggccatgaacaagttgctttccctctctgggtctcagactcatctgtaaaaataagggtataagaaggcccttccagtgctgggtccatgcctggagcctctcccacattcggtcccacctcctagatctccctcctttctatctctcaccatttaggctcgccaatgccttagttagctgcctatttatgaacatgtctggtctaatgtagtagactctggactgttcttccagcctcctgggttaacctcctgccatttgttatcccccttgcccctggaccactcctcaatgctgatctcatgttccatttaaaatctatttgttgctttctttccattgcatccaacttttcagccaccatctcaatttacctctcttattatagcttctgacttcattcacaaatatttattgagcacctcctatgtgtcaagcactgttctaggagatcaggatacatcaacaagccttcaagactcagttcagttgtcacctctcccagaaagccttctctcacttcactccttatgccttcttgcagggcaggatcactgccttcttggtgtgcaatctgctacacctgacgagattgtaacacagcagaagcaggaacctttccctccttccctgctgtctcatcaatggacacacccagggaaggcagcttcagtttatgtttgctgagtagaatgattaattttacatgtcaatttggctgggccatggtacctcaatatttggttatacactagtctagatctttcagtgaagatattttttagatgaggttaacattaatatttaaatagggcagtagattttgagtaaagcacattacccttcaaaatgtgggtaggcctcatccaatcagtagaaggtcttaagacaaaaaaaaaagactgaggtccccaaaggaagagggaattctgcttccagggtgccttcagacttaaactgcaacatcaactcttccctggagctccagtctgccagccataccctacagattttggagctgctagcctccacaatgatatgagccaattctctaaaacaaatcaatctctccctccctctctctctgtctacacacacacacacacacacacacacacacacacacacaccccctattggttccatgtttctggagaaacccaactaatacactaagtaattcaatccttcccccctcttcaccctccccccacacttatctgatacctgtggctaaagaaggtgttggaggaagagaagtggatagcttttttcatatgcttattatccatttttctaccttcctctgtgaagagccttcctttgtgaagagccataatgctgctttttctcttttattattgatttgtaggagatctctctatctctgtctctatatgttgtgaacatttcccccaacaatgtggcttgtgttctcatttcttaacattgtcttttactgagcagaaagttttgattttggtggagccaaatttatcattttcttttatgattaggaatttttgtgcctaagaaatcttttcctaccccaaagttgaaaagatattttcctatgttttctttttctttttttttttttttgaaatggagtctcactctgtcacccaggctggagtgcaatggcgtggtctccgctcatggcaacctccccctcccaggttcaagagattctcctgcctcagcctcccaagtagctgggattacaggcacatgctaccacccctgactaatttttgtatttttagtagggttttgctatgttggccaggctggtctcgaactcctgacctcgtgatcggcccgccttggcctcccaaagtgctaggattacaggcgcgagccaccatgcctggcctgttttcttctaaaagaagacttttagacttacctttcatgtttaaatttgtgatccatctcaaattaatttttgtgtatgctatgaagtagaggtcaaggtccttttctgtttcttaaggacattcagttattccagtaccatttactgaaaagattcctttcccctactgaaatgcattggtgtttttgttgaaaatcaagttacaaaatatgtatgagtttacttctcaatttgatattctattccattgatctatataattatccatacacaataacatattgtcttaacgattatagctttatagtatatcctgaaatcatccaacctcaatctttgagaattgttttgcttattctaggtccttctgacatttcctacaaattttagaattagcatatcaatttttacaaaaagtctgatgtgattaaaactgggattcatttaacaatattatatcttaactacatcaactcttccagtctatgaacacagatctatgtttattcaggtcttcttgagcttcttccagcggtgttttatagtttcagcatagaggccttccacatcttttgttatatttcttcctaagtattttatgctttttgatgctctgtaactggtatttttaaaataaactctatttttagaatagttttaaagaaaaattgtgaggaacagagtttccacatactccaaagtcagtttcctctattgtcaacaacttacattataatgtatggtacatttgtcacaattaatgaaccaatattgatacattattactcaccagactccagagtttattcagatttccttagcttttacccagtcctttctctgtcctagggtcccatccaggatgtcacattatttttagtcatcatgtcgtcttaggttcctcttgactgtgacagtttctcaaacttttcttgtttctgatgatattggcaggtgagaggagtaagagtactggtcaggtattgtgtagaatgtccctcaattgggaactgtgggtttttctcatgataagagtggggttatgggtttttggcaggaagaccacagaaataaactgccattttcatcatatcttatcaatggtactgctatgatttgaatgtcacctccaaaactcatgttgaaatttaattgccaatgtaatgatatcaggcagtggcgccttcaagaggtgattaggttataacacctctgccctaatgaatggattaatgtcattatcacaggagtaggttcctcaaaaaaaggatgagtttggccaggtttcctctatctgtctcttgttcttccatcatgggataatgcagcacaaggcttttgccacatgctagcaccatactcttggattttccagtctctagcactgtgaagaataaatttcttttctttataaattaccccgtctgtggtattctgttatagcacaaaaaagactaagacaggggccgggaaccatggctcacatctgtaatcccagcatttgggaggccgaggtgggcagatcacctgaggtcaggagttcaaggccagcctggccaacatggtgaaaccccgtctctattaaaaatacaaaaaaattagccaagcgtggtggtgggcacctgtaatcccagctacttgggaggctggggcagaagaattgcttgaacccaggaggcagaggttgcagtgagctgagaccacgccattgcactccagcctgggcaacaagagtgaaactccatctcaaaaaaataaaaataaaataaaattttaaaaagactaagacagggacatactatcaacatgacttatcactgttgattttgaccttgatcatctggctgaggcagtgtttgtcatgttttccactgtaaagttactttgtttcccctgtccacactatactcattggaaagaagtcactgtgcatagccacacttaagtggtagagagttatgctccatttcttttagggtagtgtatctacataaattatttggaattcttctgcatataattttctctgatcatccacgaatttattttgaataaataaacaaatgattgaatatcatttgtttatatcagtgtggacactggatatttactgtaaatctgggttatagtctaatactattttgttgcacaaattgtcccaactttggtctttagggcatttttcagtaggcttctgtgtccctctgacatacctccatcggtgatttttccttttgtttgtttctttatcactccctaacattctgacactacaagatgctcaggctcatctatgttatgccccagtcttagaatcagccatatctccaaggagccttggttccttttgtttgagaatggctttagaaaccaagatctggcaactaggtgtgctcactgctactgaggagttgctgcataaaaatgacatttttaatatttattcattatttaatttttatttttattttatagacagggtctccctctgccacccaggctggagtgcactggcacaataatagctcactgcaacctcaaacttctgggctcaagtgatcctcaagcctcagcttcctgagtagctagaacgacagaagagtgccaccacatctggctatttttttttttttttgtaaagatgggtcttgctatgttgcccaggctagtgtcaaaccactggcctcaagcaattctcctgtctcagacccccaaagtgctggcattatagacatgagccacatctggcctggcatcttttaaatctcattttccaaatttttgtcgctagcatatagaaatagaaataatttttaaacatttacctctgtgatggttaataatgagtgtcaacttgattggattgaaagatacaaagtattgatcctgggtgtgtctgtgagggttttgctaaaggagattaacattagagtcagtgggctgggaaaggcagacccacccttaattgggtggcaccatctaatcagctgccagcaactataaagcaggcggaaaaatgtgagaagttgagactggcctagcccaccagcctatatctttctcctgtgcgggacgcttcctgccctcaaacattggactccaagttctacggttttgagactgggactggttctccttgttcctcaagcttgcagacagcctgttgtaggatcttgtgatcatgtaagttaatacttaataaactcccctttatacacatataaaggctatcctattagttctatcatattagttctgtccctctggagaaccctgactaatatagattttgaaaccaggagtggttctagaggaacaaaatattaaggatggagttcttttgttggttttggggttttctggagttggcagcttaatatgattcgactcaaaaatactaaggactctacttctaatagtatggagaacactgatagtccttagcataaactgtttaagaaagttatgcaaaataaatgcatttgacacttctgagtcaccactcatgagaggcaaggagtttagtgactctatacataatacctttgaccatgtgtggagaaccaaggaacgtaatgaagctggttggttgctcctaagttcactggacaaagtgatgaaataaaatgattaactcagggattctgtctcttggcttcagaagcagatactgagcctcaaatctgctaagactaccctgagtgagaatcttatctcctgtagagaaagagctgaaattgtggaaaaacagacacaagctcttatcatgctagtggctgacctgcaataaaaagtgcatgaacagcctcgccaggtgtctactgtttctaccggtttttgtttttgtttttgttttcagacagagtcttgctttgttgcccaggctggagttcagtggcatgatctcggctcactgcaatctctgtctcctgggttcaagtgattctcctacctcagcctcccaagtagctgggattacagatgtgcaccaccatgcccagctaatttttgtatttttagtagagatggggtttcaccatgttggccaggctgttcttgaactcctgacctcatgatctgcccaccttggccccctaaagtgttgggattacaagcgtgagccaccacgcccagccatctactgttaaagtgagggcattgactggaaaagaatgggaccctgcaacttggaatggggacatgtgggaggaccctgatgaagctggggacactgagtttgtaacctctgatgaacctttgttaccagaaggaacagcttccccacccccagtagtggcaacatcccctcccagacccatgctgccatcagcctttctacctttgtctgagaagaaaaactctgcactgcctgaggcaacagtgatggcctcccctgaggcagttgctaggcaaaataatgttgactgtactcaggacgcacctctcaggacgcacatccccattcaactctcccatttggcctgtgcagaagacagatggatcttgaagaatgacagtggattatcgtaagcttaaccaagtggtgactccagttgcagctgctgtaccagatgtggtttcattgcttgagcaaattaacacatctcctggtacctggtatgcagccatttaccaggcaaatgcctttttctccatttcgtccataaggcccaccagaaacaatttaccttcagctggcaaggccagcaatatacctttactgtgctacctcaagggtatatcaactctccaggtttgtgccataatcttattcggagagaccttgatcgcttttcgcttccagaatatatcacactggtccatcacattgatgacattatgctgattggatccagtgggcaagcagtagcaaacacagtggacttattggtaacacatttgtgtgccagaggatgggatatgaatctgactaaaattcagggaccttctacctcagtaaaatttctaggggtccagtggtgtggagcctgtcaagatattccttctaaggtgaaggataaattgctgcatttggtccatcctacaatcaagaaaggcacaacacctaatggacctatttggattttggaggcaacacattcctcatatgggtgtgttattctggcccatgtggggtccaggcagttgtgcaagctgctctgccacttaggccatatgacccagcagatccaatggtgcttgaggcgtcagtggcagagagggatgctgtttggagcctttggaaggcccccataggtgaatcacagcagagacttctaggattttggagcaaggccctgccatcttctccagataactactctccttttgagagacaactcttggcctgttactgggctttggtggaaactgaacgtttgactacgggtcatcaagtcaccatgcgacctgaacttcctatcatgaactgggtaatttctggctcatctagccataaagtgggttgcgcacagcagcattccatcatcaaatggaagtggtatatacgtgatcaggctcaagtaggtcctgaggcacaagtaagttacatgaggaagtggctcaaatacacacggtctccactcctgccaccctgccttctctccctcagcctgcaccgatggcctcatggagggttccctatgatcagttgacaggaagagaaggctagggcctggttcaccgatggttctgcatgatatgcaggcaccacccaaaagtggacagctgtagcactacagcccctttctaggacatccctgaaggatagcggtgaagggaaatcttcccagtgggcagaactttgagcagtgcacctggttgtgcatttcgcatggaaggagaaatggccagatgtgcgatcatatactcattcatgggctgtagccagtggtttggctggatggtcagggacttagaagaagcatgattggagaattggtgacaaagaaatttggggaagaggtatgtggatggatctccctgagtggtcaaaaactgaagatatttgtatcccatgtatgtgtgacctcagcagaggaggattttaataatcaagtggataggatgacctgttctgtggacaccactcagcctcttttcctcagccacccctgttattgcccaatgggcccatgaacaaagtggccatggtggcagggatggaggttaagcatgggctcagcaacatgaacttccactcattaaggctgacctggctatggccactgctgagtgaccagtttgccagcagcagagaccaacactgagcccttgatatggcagcacttctcagggtgatcagccagctacctggtggcaggttgattatattggacctcgtccattatgaaaagggcagaagtttgtccccactggaatagacacttattctggatatgggtttgcctaccctgcatgcaatacttctgccaagactactatccacggactcatggaatgccttattcgccgccatggtactccacacagcattgtctctgaccaaggcactcactttacggctaaagaagtgcggcagtgggctcatgctcatggaattcactggtcttaccatgatccccatcatcctgaagcagctggaatgatagaacagtggaatagtcttttgaagtcacaattacaatgccaactatgtgacaatacttttcagggccaggacaaagttctccagaaggccgtatatactctgaatcagcatccaatatatggtactgtctctcccatagccaggattcacaggtccaggaatcaaggggtgaaagcggaagtggcaccactcatcatcacccctagtgatccactagcaaaatttttgcttcctgttcccgcgacattacgttcttctggcctagaggtcttagttccagagggagggatattgccaccagaagacatgacaacaatcccattaaactggaggttaagattgccacctggacactttgggctcctcctacctttaagtcaacaggctaaggagttagtgttggctggggtgattgacccagactatcaagatgaaagcagtccactactccacaacggaggtaaggaatagtatgcatggaatacgggagatccattaggatgtctcttagtattaccatgccctgtgattaaggtcaatgggaaactacaatggcccagacccttcaggaatgaaggtttgggtcactccaccaggaaaaaaaccatgacctgctgaggtgctggctaaaggcagagggaatacagaatgggtaatagagaaggtagtcaataccagctatgaccacgtgaccagctgcagaaccggggactgtaattgtcacgagtattttctctttcttttgttaaaaacatgtttgtgcatgtctacacttgtactaagaaaataccttcatttcctttatcatgttcataagatttattgacttgatatcagcatttaagtattgttaactttatgtaatagtatttgggttgaggattggtgcatttctggttatacgaacaatagttgtatcatgttaggcataattatgaccttattactctttatttgaagattatgtatgatctcaggagatgtgtatgggttcaagttgacaacgagtggatttgtgatggttgatattgtcaacttgattggattgaaggatacaaagtattcatcctgggtgtatctgtgagggttttgccaaaggagattaacatttgagtcagtgggctgggaagggcagacccacccttaattgggtggacaccatctaatcagctgccggcaaatataaagcaggcaaaaacacataaaaagttgagactggcctagcttctcagcctatatctttctcccatgcaggatgcttcctgccctcaaacattggactcccagttctacagttttgagactgggactggctctccttgttcctcaagcttgcagacagcctattgtgggatcttgtgatcgtgtaagttaatgcttaataaactccattttatacatatatatatatcctattagttctgtccctctagagaaccctaatacaacctcgtatccgatactgtgagtcacttactagttctagacattttttataaattcctttgggatttttgcatacataatcactttgtctgtgcatacagttctttttcctttgtaaatctactatctttttgtcttgtcttcttatatttgctagggcctccataacaatattgaatagaactggagaaagtggccattcttgctttgttattaacattttaaaggaaaagcgcatatctcaccattaataatgatactatctgtaaatttttcatagttatgctttatcaagttgaggaaaatctcttccattcctagtttgtcaagagcccttatcacgaatgggtgttgatattatttttatttttatttatttttgttatgatttttaacaagtttttcaaatgcatttttctgaatctattgagatgattgttttctcctttattttgttggtacaaattttttatttagacgagtcacgtttattgatatataatttacatagtaaaattccccacatatacaattttatgcattttcacaaaagcagagttgtgtaactgccataaaaattaaataactgttctattaccctgagaattccatgtgacccttggtagtcaactccttctgccaccaccattccctggaaatcactgatctgctttctgtccctatagtttttctggtatgtcatataaatggtattatatgtagtcttttgagtctagtttctttcatttagcaattcatttgaaaattgaaaaatgaatttcctttgaaattcatccatgttattgtatatttcctttttattgctaagtattctgttgtacagatgtaccacagtttctaatcacctcacagttgaaaatattttgattttccaattcagggcaattatgaatttaaaatgctataaatattcatatacaggttttagtggaactgctgggtcatactgtaagtgtatgtttaactttataaagaaagtcccaaaacgttttccaaagtggttgtaccattttttattcccccaacagtgtatgagagttttagctgcaaatactagcattatattattttctggttattctaacaggcacatatgatatcttattgtagttttaagttacatttgcttaaagactaatggtgtttagcacctttttgattatttgccatccatatttatttatttttttctttttttgagacagactctctgtggcccaggctggagtgcactggtgccatctcggctcactgcaacctctgcctcccgagttcaagtgattctcctgcctcagcctcccgagtagctgggactacacgtgcctgccaccacgcctggctaatttttgtattttcagtagagacgggggtttcaccatattggcccggctggtctcgaactcttgaccttgtgatccacccacctcagcctcccaaagtgctgggattacaggcattagtcaccgtgcctggcccatatctattctttggtaaaatttttattcaattatttttcctattttagaattgagttgtttacacacatatacattgtattttcctctggatacagatatgtcttttgcaaatattttcttccagcctagacctcatcatttcagtttttaaataatgtgttttttttttttaaaataaagctttgtattagtccatcttcacactgctgtaaagatactaccagcgactgggtaattaataaaggaaagcggtttaattgactcacagttctacatggcttgaggaaactttacagtcatggtggaagttgaaggggaagcaagacaggtcttacatggtggcaagcaagaaagacagggtatgaaagaggaactgtcagacacttataaaaccatcacatcccatgataactcactcactgtcatgaaaacagcatgggggaaaccgctcccaggatccaatcacctcccaccaggtccctcactcaacacatggggattaatgggattacagttcaacatatttgggtggggacacgagccaaaccatatcaaattttattctgaagctttgtgtatctctttttttttttgggggggggggggatggagttttgctcttgtcgcccaggctggagtgcaatggcacgatctcagctcactgcaaccactgcccctggggttcaagcgattttcctgcctcagcctcccaagtagctgggattacaggtgcatgccaccacgcccagctaatttttgtatttttagtagagacggggtttcaccacgttggccagccggtctcaaactcctgacctcaggtaatccacctgccttggactcccaaagtgctgggattacaggcataagctaccgcacccggtctgtgtatctttttaaagatggatgtctatggggttgatataagaaacctttgcctaacacaagagcataaaggtgttttcctctatatttttcagttttaggaattatttttggtatataatctagtttttcttaataatgccttcatttagagtcaactgactgttaattattgacatattttatgcaatttttaagcaaatgacgtttacaaactgtttgctcgtgtacacttttttttaaaaaaaaaaaaatagacttcagttttttacaccagttttaggttcttagcaaattgaggggaaagtacagagagttcccttataccacctacccccacacatgcacaacctctcccactgtcaacatcccacacctgagtggtagatttgttaataatcaatgaacttacattgacaaaatattatgacctaaagttcatagtttatgctagggttcactctttgcgttatacattttataggttttgacaaattcataatgaaatgcctccaccattatttagaatagtttaactgctgtaaagatcctgtaccctgcctgttcattcctccttccctaacccctggaaccactgatctttttactatctttatagtgttactttttcctgagtgtcatatagttgaaataatgcattatatagccttttcagactggcttccttaataacatgcatctaatgttccttcatgtcttttcatcattgatagctcatttctttctttctttttttttttgagctggagtttcactcttattgcccaggctggagtgcaatggcgtgatctctgctcactgcagcctccgcctcccgggttcaagtgattctcctgcctcagcctcctgagtagctgcgattagaggcacccaccaccacgcccggctagtttttttatttttagtagagacgggatttcaccatgttggtcaggctggtctcgaactcctgaccttaggcaatccacccacctcgaactcccaaagtgctgggattacaggcatgagccactgtgcctggcctgctcatttctttttaacaatgaaaaatattccactctctggatataccacagtttatttttccattcacctactgaaagacatcttggttgctttcaaattttggcaattatgactgaaactcctaaaaatatccatgtgtgggttcgttttttttgtgtgtgtgttaagttttcaactcatttgggtaaataccaaggagtatcattactggatcatatggtaagagtacgttcagttttaagagaaacttctatactgtcttccaaagtagctgatatgatttggatctgtgtctccactgaaatctcatgtctaattgtaaccctcggtgttaggggtggggtctggtgggaggtgatttaatcatgggggtggattttcccctcggtactgtgtggtaatattgagtctgttcttgtgagatttagtcactcctctccatctactcctaagatcttatatgaaagaaaaaaattcaccaaagatgattaaaaaagaataagaaccagaggcaaggaggaaaataatttgtatattgtttacatgaaggattaaatccaattaaatttgtgattttattaaatctttttcaactctgaaaaaagcagcacagtaagggacatagcttgaccagttattaaaacacagtataaagcctccataattaaaacagcatggtactgacacttgaatggactgattactaatagaacagaatagaaagcacagaaatagatataaatacacacaggaatgtgggttttaaaagtggcttataaaagtaagagagctgaattatgaaatgatcctttacagagagaaaaatgagaaagcccctcaattcttggaggaggaaggctctgaatgggatctttactttccctccttctatccatggtgttggatttgtctgagctaaaataaaatgcactcactgtaactttgtgttcctttctaaattcaggtaatttggggcagctggacagcagtagagtttctgcttcattaagcctccattcaccaccacgctcttcaaagcaccccctattccccaggcttggccctccacctcaggctctgcatctctcctgctgtgggccagctgttcctgggctgtaatgtgaaggctcttcagaggtcataggcccttcccaaccctcaccgaggcctaagcccagatatatatgaaagcagaaagctgctctacatgtggctagcactccacctggatttaagccccagaattcggattggtctgagggcagtgtggttatcacagaatttaaaaactccccaagttgttctaatatgtagctaagattgagaacagccactttacatttttagctttctctccatacattttggtagatcattctctgatgatgcatgaataagataatgttaagtaaaagcattataagctacaatgttatgcattaatatcagaaccttcaggatggggagaacagggtgaatttgagtagggatgctcacattttagctgctaatcagtagcacatttgtgctggggaacatggtgaggccttttgttacaaatgttgatttcagatccatctatctctttcatgtttcttctaatagctctattgctgccaattacagaaagtgccgatggtctcactggtattcttaggtgagcacgtttcataaggaagcatccctgttagccagcccgagttggagggtttcccctccacaaccctctccctcaagaaagcacaaaaagatactctttttgagcagccatgcattctgtttctgtttcttaatttaaaagcatgctaacctgttcacaatcccttgtgggtcaccttttaaaaatatttttgtagctaactttgtaatatttttaagtttctacactttgcatttaacttttaatttaaacctcatttatttaaaaatatatgtgtcaaacttattttattcatcagttcactcagtggtttttaagttacctttatcataatactagcctttagtatccagtttcatttacacattaaaaaataatatacactgaattttataaatttctatcttgcttagtataaagttttattaaaaaactatcatgtgctggagaagtaggaattcagatttgagttttacaaaattcattctggtaacaagaaaagctcctgatttgtcagtttcagttatcctctaatttgccttcaaattctaaatgattggaaggcgaaatggggcaaggggcctcaagagggaaagttttgcagaccttttaggttctcctagggtctggaagtcctttctgaggtcatatatatgtactttacttgtgcaattttatattttgtttctccctaacaggactatgtacacttataagcagggataggtacagttctcagatgcttccataaaaattcagcaccatgctaagtacagggtagggtattagtaaataattcttgcaggctgggcgcggtggctcacaaggtcaggagttcgagaccagactggccaacgtggtgaaatcccatctctacaaaaaatacaaaaattagccgggcctagtggcacgtgcctgtagtcccagctacttgggaggctgaggcaggagaattgcttgaactcaggaggtggaggttgcagtgagctgagattgagctactgcactccagcctgggcaacaaagcaagactccatcttgaagaaaaaaaaaaattcttgaactcagaggaggctttaccattaagttgaaggagtccaagctctacagccccttcaaaggcctcagaaaaactctagtaatgtgtttacctggtcatgtgtatacaaatacagataattgtagataatgtagcatatacaattataaacaaatgcactactattttttaataggaattgtgaaaaacaatttattggaatgctgtgtttttcaggcacaacctgcagtggtattgaggcaggacaatggggtctggaggcagagaacataaggccaattcatgctgatttcctagaactaaatcaaatggaaacacttcagctatgataggaaacatcctctccatttacatagggtgtacaccaagtgaatgactttgtaactttacttcatcatcttcatttacatagtgtgtacaccaagtaaccaatggaaacctctagagggtatttaaatcccagacaattccgtaacgggcctcttgagaccctatgcttgggcccgctcccaccctgtggcgtgtactttcattttcaatacatctctgcttttgttgcttcattctttccttgctttctgcattttgtccaattctttcttcaagatgccaggaacctggacaccctccattggtaacagtaccacaaacagcagatttgtgaaactgcatgctctttaagttcttatcaacttttctagaacaatgaattatcttttgtcactatagaaaatatttcaaaatataaagatgcactcgagaaatgcaataatgtagaaaaaatgtttatagtgatatgtcaagcagttaattaataaaatttttttctaggctttgtggtattgctcaatgtgccaaaaagggttaactcagcaggctcagattgttcaaaccctgcacatgccaaataaaggactgtcccttgatcagctcctgggaagagaacttctggccccctagaatatcctgtttttgtctgtctgaatccctgagccatgctgtatcagtttgacctctggggactagagaccaagtagctaaggtcagtcattcagatgttgatgcctgtgactgacccccccgctccccaataaaaaccatggacaccaaggctcaactgagcttccctggttggctgcactctacctacaatgacacattgttgctgggataattcagtgctgtctgtgcaactccactgggagaggacaaatgaaaacttggacataatttctcctggacttcaccccatgtgccgttttgtttgctgagtttcatccatacccttctgttgtagtaaaccattaccatgaggaaaacagcttttgttgctgacatggagtctcactctgtcacccaggctggagtgcagtggtgcaatctcagctcactgcagcctccgcctcccaggttcaagtgattctcctgcctcagcctcccaagtagctgggatttacagtcctgagctaccgcacccagttagtttttgtatttttagtagagacagggtttccccatattcaccagtctggtcttgaactcctggcctcaggtgatccacctgctttgccctcccaaagtgctgggattacaggcatgagccaccgtgcctggtccaaaacatcttctctgagtccctttataattgagcctgtgggtactctttaagaactcccaacaaagtcagcttttaaaatcttgaattgccatgacctttctcattcttaatgaacactgactttcatacctcttagtataatactagtattcccagtactgcattttcctaaataaggaccctaaattgtctaatttccacctccacaaaacctggacctacccttgtgtatatgctcacatcctgagccttcacacatggtgctatcttcacttggaatgagtctgctgaactgatccacctgaaaattctgttcttcgtttggttctttgccagaagtttgtcctccttgtcagagcagttcctccatccccaccacccataatactttacaaagagctgctttagcacttactgcattagaatgtggttaccttacattacagatgcatgtgtgtgtgccttgctagaccaggaatggactggctctgtcattttgattctctcagaaagggagggagaggagacagaggacaggtagagaatcagaatttgtgttcatcaccagacagacatggagtccatcactgactagctgtgagatgttgggcaagtttctctcagtgcttcagtttctttgccgtaaaaccacttgctgaaataccacttgccttacaggttgttttgaggattaagtgagaagatgtaggtgaaaagacctagccagcaatctgggtaaagcctaagggcacaggatctggaatgaggtgccctgactttgaatttcatttttctcacctgctagtgtgtgacttggggcaagttatttcacttcacctcaatgtgtctatcatgttatggagacaagagcatctacctcacaggaccactatgatggttaaatgagctagccagtgcctggcacataaggaggaatcaataaatattggctattagacattcaatgaaggctaattcctttgttttatggcataaatctgtgcatagacttgggcatttgtgtttatttcctttaaattaatataatcctgcctgtacctctatggcagggcaggcagaaaattcagcctcaggcagacagagctcccccacgcccatgtctaagaggtgctgcaagaggtcccaggtattggtcatcagctcctacagctgctctggagtcctcattcaatatctactgtcctctctcccagtcttggaagattgtcttagtctgggcaggaagaaccatcccctcctccctcccaacccctgcagaacctccagcaacattccctagaagggagggcagctacgaggcaactgggaaggccagggtggctttctatcttaataagagctcccccaaagcctggcaactgctccaacagctagacttgggtgtaaggggacaacagagggcttcaatgtatatttctcctactactactatttttttactccagcagactttccactgcaactgggattctcttgcatagatggaagcctctggaataagtaggcctatttacaggcagatgagagcttcaggaagctactatttcctacagtcctaaacgttcattccgctactcaattattgttatttatcaaaggcatccaaacttactaggcattatggttcttagccctggctgcacctcagaatcccaccagggagctttaaaaagtgcccatgcctgggtccccatcctccagacattgactcagtttgaagtagggtccagtcacagatgaatttttgcaagttccccaggtaactgatgtgcagccagggctgggaatcactgggttaggatttgtggatatggatgaaatgggtgtattatatatagagagagaccttacactgtcctttggagcccaccagcaccacctccctagccttatatagtgtagttactgttcttccaagagatggcagggcctgatgggaaatgtcttgggttgaaagtcagtttggagtcttaattatttcatttttggtgaacagtctgtggcctgatttccctttagaaaataagaagttaggaggtgaaaagacttctgccctgtattcttcaggggattctggaatgtagctttttgggggaaaagttatataaaagacgttttaatatctctaaaaaaagtcagtaccctaatacaaacagtatgttttaatacctttatctctcttgagagcttaaaacactatcccctctcagctctgagaccttcaaaggaaataaattggtggtggtattgccaagttagtaagagcaattaaaatgtaacctggcactagtcacaaaataagtaaaatgtagtaagtttattatacacaaaatacattcaattacaaaatatactaatgagcagtttaaaaccaggttgatttcaaactagaaattcaaactgagtgaaatatatgaatgagctcatgctggcaaatactttgatacctttggtctcataattttatcagcttgcattgcttcactgctttttacatttttagttgcattcatggtcctaatgaggagggaaaatgttcgtatttgggcttaagtaggggctaggaaaatgagaaccatttattccaacctaagatttaataattagattaatttctatacatttccattaattaaaaggtagtgtaatagcacttagtaagtgctcagtattgctctgatagctttacatgtattctaatcctcaaaactgatgaacccaaaaggaaagtactccgattaacctcattttacacaacaggaaactggaatacagaataattaagtaactttgccaagatcatacaagcaacagaaaaggcggcagaattcaaactgaggcagtctggccacggagcccatgctcttaacaatgacttcactatcctgctagaccctgctcaaaaatcttaatttcaattccgagtgaggtggaacatctgattcagcttccattccattctccttccagaaacatcatcccaaaccacagaacacttgtctttctttgcacttctcagtatcaaaggagaatatcgtccttcatctggtgagcacattagctgatcctgtttacgtttgcttctaagagttggaggcggtccatgtattagactaatccaatcaacaaatattaagcacctataaaaacactgaggtaaaggagagaagaatccagtctttccttgcccagagaaggtttaccacctagtgagggagacagataagctgcctctgctgggcagtgagataattgccacaatggagggaagcacatgctgctaagatagctcctgacagaggcaaggacccagagctggggaggggcaggactgatgggaaagtgttcctggagaggtggctcttaaccttggccatgtattagaaacatttggagagactttaaaagattgccaaccccagaccacaaaccagtctaattacattagaacctctcatgccctaaaacagtggtccctgaagagcagcattagcatcccctgggaacctgttagaaatcccatgccaggtttactaaaccagccctcaaggggatttcgatgcaaactaaagtctgagcagtggttctgaagcttaaacaggcatcaggatcctttcagggttgcttaaaatacagatcgctgtatataaagcatactgagacccagactgctaggtcacccccagaggttctagttccataggtctggggtgggaaccaaaaatatgcatttctgactggttgtcacggtgcacaattaatgagaaccactgtcctagaggaaaggatggccaaattggaatcagaaaggtaagagctggcaagctgaaggatgtggataatgggatgaaaacatattcaacgacaatcaagcaccagctacatgccaggtgctgctctagatgctaagactcctggaaggaacacagcaaagtccctctctcaggagcttacctgtccaggaacacagataatagacattgtctgaaagtgacaaattcaatgaagagcctcctacactccttttcccccctcacacgtttccccccagtgtgaggggggaaaaaggagtataggaggctctttgggtcagagtactcaggtaagagctctctgtgaagacaactatggcagactgatgcttgtcctacaatatctttttttcccatcttataaagcaggagaatgtgagcatggcacatggcaatccagaaaaaagactgcatttcccagcctcccttacagctgctgagaccacagggctaagttcctgccaatgagaggtaggcatcaatttgcaacttacaggaacctttctgaggaggattagcctttgtccctccttttcctcccttcctccatcctgctgcttggtttgtgaatgctgctaccttagaccataaggacagaaaacatgtcccgggactggcagagcagtaagccaaaaggaaccagggtcccgtaagacgatggagcagagcctttttaccagccctggatagcaaagttctaaacaaatatatgtctagattatttaagccactgacagcttgggttgtcttggtatttgtgacagaaactaatactagttcaatggcttttgagtagagccctaaaagaaatgagggagcaaagcatgtagatatctggaagaaaaagcattctaagaggaaaaaaaaaacaagggtaaaagctcctgatgtggggtcatgctcagagtatttgaggaacagcaaggaagctagggtgcctggaataaagggagaatgttaaaaaatgaggacaagaagtattgatggagggttcagatgataatagggttatttttaaagtaaaaactggttcattcatataaaatatgtacataaccatgtatattttgaagaataaggaaaacatctttgtaatcaccaccaaggtaaggaaaatgttgccaggaccttgaagtctttctctgtggctcatcctcttccctgccccagaaacaaccactatctccaatttttttataatcagcatgtagctttattttatagatgcaaaacctacatatatttctcttgatgaaactgctgggtctactgggtgtgcacatgtataaatttactagataatgccaaacttttccaaaatagctatgcttattctaccatagtgaattaaagttccctttgtcctgcattctcagtgcttttagattttaattaaaagtgtgtaatgactgaaatgtacactttaaaatggttggtggtaaattttatgtgtcatacaactcagacaaaaaagtgtggaatggcatctgtttctgtttttccctgtactgagattaaatatttttttacatttacgaagattttcagatacctcctatgtgaattgcctgttcagtctttcacccatttaacattttgtagtctggctgggtgcagtggctcactcctgtaatcccagcactttgggagtccgaggcgggcagattgcttgagctcaggagtttgaggctagcctgggcaacatggtgaaaccctgtctctaccaaaaatacaaaaacttagccgggtgtggtggtgcgtgtctgtggtctctgctacttggggagctgaggtgggaggctgcagtgagccgagattgcgacactgcactccagcctgggtgacaatgagactccatctcaaaaaaatatatattaaaaaatttttatagtctgtctcttaattcacaggaagattttgtattttctgaattctagtcctttgtatgatgaatgttgccaagtatctcctcacagcatatagtcagtcttttcgctctttctggtaacttcggaggaaacttttttgacagggtctcactgtcaaccaggctggagtgcagtggcctgatcacagcttactgcagcctcgacttccccggcccaagtgatcctcccacctcagcctcccaagtagctgggacgacaggcatgtgccaccatgcctagctaatttttaaattttttgcagagacagagtccctatgttacccaggctagtctcgaactcctaggttcaagcgatcctcttgccttggcctctcaaaatgctggattacagatgtgaactatcttactcaaagcaggaggcagtctacagagtaaaatcataaaataaatgcagaaaaagcatttgatacaatttagcatccatttacctaggaataggagcgaattttcttacctgatgagggttatctcttaactacattaatccattaacaaaacattgcattcacttttatttttaattatttatttaattttggagacaggccatgacatccagcctgcattcagtttttctgaggtaaaaccatcattaaattcctgggataaatccaacaaatcagtattttgttatcctttttaaaacttcatattcagtttgcaagtatttcaaatttttataactgtaattatcagtgatactagcttacattttttctttttcatactatccttgttgagtttggtgtctcaaactcctgagttcaagccatccttaccctcacaaagtgttgggattacaggcatgcgccaccaagcccggccacgtataactttaggatggttttacctagtaataattctgtggctgttttgtttgatactaatacaactacatcagaattctctaggttacaatttgctcagtgtagcttttgctatcttttaaatttcaacatttattattcttatgttttatgtcttttataaatagtatattatttaatatttgatcatctttgtctcataactggagcatttagtctattttcacttagtgtaaaagtggtcaacatgcaaggacagatgaaaactagaagagtcaaaggcaaaagctagaaatcaaaacaccatcatacaaacgaagaatcccatcaatgagctcatcaacagactggacccagctgaggaaagagctgatggacttgaacaaatgtcagtaaaaactgtcaaaactgaaatgcgaagaggaaaaatgaaaaaatgcacaacaaaatattcaagagctatggaacagttacaaaaagtgtaatacacaaatgggaatactagagggagaagaaagggaacagaagaaatatgtgaaataataacagagaatttcccaacattagtgatagacacaccacagatccgagaaattctgagaacaccaaaaagggtaaataccaaaaaagtctacacttaggcatatgatattcaaactgcaaaaaatcagacaaagagaaaatcttcaaagaatccagaagaacaaaacactctacctatacaggggcataaataaaaattactttgtacttctcttcagaaaccacgtaagcaataaaaaaggactaatatacttaaacatcataccggaaatcttagctaatgcagtaagataagacaaggtatgcagactgggaagaaagaaatgaaactttcttcacagatggcatgattattacgattataaagaaaatcaaaaagaattgatggggaaacttctgaaactaataaatgattacagcaaagttggagaatacaaagctgatatatagaagtccattgctttcttatatataagaaatgaacagttggaatttgaaataaaaacacagtatcatttacattggcatcatttacattagtatttcattaccaaatgcaatacttaggtataaacctaacacaatatatctacatgaggaaagatctacatgaggaaaattataagaccctgatgaaagaaatcaaaggactaaataactagaagagatattccaattccatgtctatgaataagaagacaatatcatcaagatgtcagtttttcccaacttgatctatagaatcaacacagttccagtcaaaatctcagcaagctattttgtggattcctacaaatacaacaatgaagaagaacaatgtctgaggactgactctacgtgacttcatgactaaccataaagctatagtaatcaaaacagtgtagtattggcaaaaggtgagacaaacagatcaatggaacagaaaagagagcttagaaatagactctcataaatacagtcaactagttttttttaaatttttaaaattgttttattttttgagatggagtctcgctctgttgcccagactggagtgcaggggcatgatctcgagtcactgcaacctccacctcccaggttcaagtgattctcctgtatctgcctcctgagtagctgggactacaggcacgcacacccccacacctggctaatttttgtatttttagtagagacagggtttcaccatgttggccaggctggtctcgaactactcatgtcaagttatcagcccgcctcagcctcctaaagtgctgggattacaggcacgagccactgcatctggccctgatttttgactaaggaacaaaggcaatggaaaaaagatatcttttcaccaaatggtgctggaactggtaagccacatgtaaaaaataagtctacaaacagacttcatcctctatacaaaaattaactcaaattggatcaaagtcctaaatgtaagagttaaaatctataaaactcttggaagaaaaaatgagggtaagtcttcatgacctcgaatttggttggcagtggatttttagatagaaaaccaaaagcatgaacaacaaagaaaaagacagattggagacttcatcaaaatttatgtgtgcttcaaaggatagtatcaagaaagtgaaaaggcaatccacaaaatgggagaaaatgtttgcaactttgtatttcttaatgagggcctttatctacaatatatgaaatactcttaaaactaaataataaagtcagatagcccaattaaaacatatgcaaaggatctgaatacatatttctccaaagaaatatacaaatcaccaggctgggcacagtggctcacacctgtaatcccagcacttttggaggctgagatgggcggaccacttgagcccaggagtttgagaccatcctgggcaactatctgtaccaaaaaattaaaaaaaaaaattagctgggcatggtggaaaaaaaaaagccaggtgtggtggtgtgcacctgtagttccatctactcaggaggctgaggtgggaggatcacttgaactcaggaggtggaggttacagtgattgagatcatgcaactgcaccccagcctgggtgaaagagtgagacgctgtctctaaaaaaagaaagaaaaaaaatacaaatgaccaataaacacatgaaaaaaaatgttcaacatcatttgataaatgatcattagagaaatacaaatcaaaaccataatcagataatatttccaacccactaggctggctgtaataaaaaatagtagtaacaaatggtgagaattgaagaaactggaaccatcgcatattgcagggggtaatttacaacggtaaacagccactttggaaaagcctggcagttcctcaaaatgttaaacatggaattatatatgacccatcaattctactcctacgtatataacctagagaaatgaaaacatatggatacaaacacgtgtacatcaatgttcacagcagcatcacttataatagccaaactgtggaaacaatccaaaagtctaccagctagtgaatgaataaacaaagcatggtatatccatacaatgttgttgttattcggccataaaatggaataaaatactgatacatctacagcatagatgaactttgaaaacattaggctaactgaataaagccagtcacaagaccacatacatgattccatatgaagtgttcagaacaagcaaatacctagaaacagaaagtagattagtggttgcctagtgttgggaagtgtagtgcaatgaatggggagtgattgctaatgggtatgtagtttctttttagggtaagaataatgcactaaaactgatcgtggtgatgattacacaatgctgtgaaaaatactaaaaaaagcaataaaccatacactttaaatgggtgaactgtatatgtgttatggagttgaaatgtgtctcaccaatggggcaatatatatatatatatacacacacacacacacacacatatatatatacatatatacacacatatatacatatatatacacatatatatatacatatatatatatatatgtgtgtatgttggaatcctgacccttcattcctcagaatgtgactttacttggcaataaggtctttacaggggtaatctaattaaatgaggtcattaaggtggatcctaatccaatatgactcttgtcctaacaaacaggggaaatctggacacagagacaaacatgcacagaaggaagactatataaagagacacaaggagaagactgccacctacaagccaatgagaaaaacctgcaacacattcttccctaagaggcctcagaaggaaacaaccctgctgacaccttcgtttcagacttgtagcctgcagatcctgagacaatacatttctgttaagacaccctatttgtgcagctttgtaaaggcagccccagcatatatgtaaagctatatatgtaaagctttacatgtgtgtatatatatatatacacatacacagcaacctgcatactgtgtatatatacacatatatacatgtatacatatgtacatatagctatacacatatgtactttacatatatatgtataaacacacaaaggaacgtgaatatatacatatacacacacaaacttataagaaagtaacttcaaatataatggcatagttaagttgtaagtaaaaactgttctagacactcgattagcaaaacaaaaaatcttggccctcacggaacttacattctagtggaatattaatagttgagcatatcaaggagtgtaggtcaagtggctgggggaaatgccactgactggcaagattacacctacatttccagggcagagagaagaaaatgagttcccaaagacagaaaaagacatgttggcacaatagccaagaaatggaagagactgtgtcaactgcagatgttgaaactagtaaaaatcaagtccaagagacttggcaattaggagtacatttgacttcaacaaaaataattccaggagtgtgatggcagctgagattctagcatgtaaactacttgccagcgactttaggagattacctgagccactctgttgcgccaatgtgacaaaacccaccctgaataaatccaacctttgactgcttccacaactatggcttcgacaatgggcattactgaagaaagcactgccatttagctatcactgtaagtctacggtgtccaactcaccgctagtccattctctaattctccaggattgctatttcaaactagctgttatactcatacatcatccttacctcctccttgcttctggaaccaataacatcaatcatatggttctcaaagacatgaaagccaaaccactaagtaactcttttaactctctgctgttcaaatgacacacatgcctatgtccacaaccatcccttcatctgcctttgatctggatcccaacttcctcctcctgttcaggaaccttggtgtaccaatgatcttagtcaacccctcctgaacctcccgcatttttacctctactgattccatctcactatcctattagcagttaaacatgaaattcaagtttcttccactaaaaaaaaaacacaacaacatcaacaaaacacgccaggcacagtggctcacacctgtaatcctagcactttgggaggccaaggcaggcggatcacctgaagtcaggagttcaagaccagcctggccaacatggtgaaactccttctctactaaaaacacagaatttagctgggtgtggtgatgcgtgcctgtaatcccagctacttggaaggctgaggcagaagaattgcttgaacccaggaggtggaggttgcagagagccgagatcagaccactgcattccagtctgggcaacagagaggctccgcattaaaaaaaaaaaaaaaaatccttcaaccacatataattctattgctgtagctctgcccttcgttaacagtttttaaacagttgcccatacgtgctactgcatttctttactttggggtcctctcccaccacaaactaggtagaccctgatcactccactgaaattgttcttgatgaaattacgatacggcctggttaagaaagccaaagggggccgggcgcggtggctcacgcctgtaatcccagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaaaaaaaagaaagccaaaggaagacaaaaattataattcctcatttataagattcatattcctccctctcctacattttaataggatacatattgaagtattttcattgaccaatgaaagcaatgggtcatagtttaattagcaggtttaatttttctttaatgtcttacaatcaggtacttagattcaataaaatatggtggtattttaaatgaaagttttttaaaaaatggatacttacttttttaggttgtatcagcagcttttaactccactaaccacttgcttcttgaaatactctattttttggcctctgtaataccacgttattttccttcagtctcagctgctgcttcttgatttccttgtgttccttttccagtcttcttttctcactcatcaactcctctggatgagttcatccactttcatagtttcagtgctactacccatcaattggtaggatatgtctatagcttgtcaaatagcaggtgggcatgtctttcagacatcaggtcaactgatttttgttccagttccaaagtattgagtctaataatgatttgggtcaggtggctagccatcacagtgaggataaattatgtttacaattatattgtagcactctgtgtagtgtacctgacccagataaggtggtcctcagtacataacctagagtagatcatatgaagaatttctccagccttttatacacagtagggtgggtctacaaggagttgcttacacttccaggtttaatacacctactcccatattatccccactgtgcactgctctacccacccctcattaatggcccttgcccctgtaagttttggagttcagaaggtgagtatgctgcctttcaacacctcagcatccatctcccgtaccacctaccctaaacatgcacctccttctgttttcctctcttggtgaatgcttactgctgaggtattatatattccaaaggtattgaatttccagtcagcataagtcaaatgcaaatggttatccaccatttcttcatccaccaatatttactgggcaccttctatgtagcccatatcatgttaggctctgggatgcaagtgaaaaaagttatcacctctgccctcatggagcttacaatctagtaggggaaacacacaatatgcagggattattttatgtattaagagtatataaaccagggtactgggataatagttagggaacacttgctttttagatagaatgatcaagaaaggcctctgagaaagtagttaaaactggatttgaaacctgactcctcaattacaagctgcatgaccctgggcaagtaagtcgcttatcctgtcagaatctgtttccacatttgtaatatggagataatcatgccaaactcaacaaattctcattactactaatgatcatgaaaactcttcaatgtctcatcactgttttacaaggcccttcacgatctatctatgcatatttctcaatattccttagcaaacttccagcaattctaaacatttctggccctttttggacaagcttttcatcaatcctcacatttctccacattacttctattaaatcattgaggtgcctcatttacatgctcttgtagcaccctatactttgtcttttaccattaacattgtaatctccctatttcacacctctgttgacgctattggagcacaactttggtgggggcaggatcctgccttgtgttccaagtgcctgatacaatgcctggcacctaatataatctcaaatactggatgactgagaccatttgtaagccaagaaaagcagcagtagagaggtgagagacatggagataagagaggggaagtctgacagaggaaggtcctgaagatgacaggaggagaccagagtcagttggccttaaaggcctacctcattctctgaaactggaaacaaaaaaggatggaggtggtcataggtggggaagaaatcatgctttcggactgtcccttctgtttgaattaagcagcaaagtcatcttctgagaaggaagtggcctgaaaagagggcaataacatttgttataactgatgagaatgggcaaaggaactatgctacgtcatgtcggaggatggataggttactgaggatttcttcaaggctgcaataatgaaagaacagtctggacaagtagcaaagaggaaaacagaaagcgtggttcagtagacgaaaatgctggaggtaaagtaaccaatacctcacagaccaacttggataaatcatctatagaatgttcaagatattaataataatgaccagaatcaaggaaggcaaggaacactgtgagtcaaagcttccagcaaatcaaagggaatgatcaggcagttataagactagaggtagctgatagtataacctcttggcatgagcttcagaggcagagattttttagagacgtgtaacgatgcagtaggggggaaggacagcaaccactgtatcttgagatatgtagaatgtgaacacagcccacgctggtgtgagctgtagggtatggcagggcctcaggtggcagccaaatttgtaatgggcaaggcagtgaagagaaaaatcaaaagaaaaggctaagatgtagccaagtatggcctaggaagggatcagtgactggggcgtgactagaacataatacagaatggagataagtgaaggcaaaaatggatgacaagggaggtttgtacttttatttaaaagactgcagaaaaaccaggaatgagcctcatggatgcttcatttctgaaatcccatgcttaacattcatcactgtctcccatacatgattcgtcttcactctaaactgcctcctgtctctgtagatagtgccattaacatccaagttacccaggcttgaaaaatggatgaaaaatgcactcaacccttactcctatattcagtcactgaatcttgagtcttcctttgaaatggcttcagcatccactccttccttattactctggccatcatctgaaaccagttctcataattttaagtctagattcccatatcagtctcctagatagcacagctaattaacgtcacttcagtttacgcagagagcttttggggtaagtctaggtcagactcccaagtccactactcattcactgtgaccttgggaaacttacctaaacctgtttcatttgtaaaatggggaataacaccactttcctctgagaagccattgcaagaatgagacattcttggaaaattctttgcacaatgcctgttactttttttttttttttttttttttttttttggtctcactctgtcacccaggctggagtacagggtcatgatcctgagtcactgcaacctccgcctctcaggttcaagcaattctcatccctcagcctcccaagtagctgggattacagacatgagccatcatgccctaattttttgtatttttagtagagatggggttttaccaagttggccaggctggtctcaaactcctggcctcaagtgatttgcctgccttggcttcccaaagtgctgggattacaggcatgagccaccatgcccagcttaagaattcttgatttttggaaccttgattataagctgcctgatgtctggaaccaaaacttctgtaacactctattccacgtgtacttacaaaacactctaaacatttattaaacagtttgatgaaggccaaaataagaggcatatgctattctacaacacggtaacactcttcgtcacttaaaataattaagctttgagaacacaaaataaagctttttaaaaaagccattcagaaataggaagcagtttgggaaatgattgtgctacgccaatcaagaaaatgttgtacctcaaacatctgaaggtagcaatctgtttttttctttccctgcagctacccttattggaaacataagggaatataaagtgaaaacaggcaatgtttgcctgtttttatagcttttagccttaccacttttcagtttggggatggaatgcctttggctcagtagattctactggctttggggagctcagaaaggccataatggggcctacaggaagaggaaaaagagagctgacctcttaagggcaggccttaggtacaagaggctttttttaaaaagtgacaaaacttttgaactaaagatggaaaacgtagtctgacaaagaatatttgtgcaactttacagtgccagtaaaatcatgggaaaagcttggatagccatacgtaggtgtttctgaaacatgtcagattttatatatatatatatatatatatatatatttttttttttttttttttttttttttagagagtcttgctttgttacccaggctggagtgcagtggcacaatctcggatcactgcaaatcctccgcctcctgggttcaagcgattctcctgcctcggtctcccaagtagctgggactacaggcgcctgccatcacacccacctaatttatgtttttgctagagatggggtttcaccatgttccatgttagccaggctggtctccaactcctgacttcagattatctgcccgccttggcctcccaaagtgctgggattacaggcgtgagcctccatacccggcccatgtcagatatatttaaaactaagaaagcttgggaaaatctctgccaatgatctccatatcagttaaccccgttccatagagtcagaaaggcagagggtcttagtgcagatgcctgcataaagataaaacgttgcatgttcttggaaaatatggctagaccacccttcccataccatctagctgcagtataaattaacatacccatgtggaaaagtggtatgaatcaagaactacaaaagtgttcatatacccttgactagaaattccacctccagtattttatcctaagaaaataatttatacacaaagacattcattgtggcattatgagatataatctaaactgttcaaaataagtaaaggttatatgaaacatggcacatccataacaatggagtaccataaaattaataatagttgacacagttttaatgacatggaataatgcctgtaggttgcggggaaaaaccccaagatataaattacactgagaatgatgaaactaagtaaaaatatgcagaagtagcaaagacaatggcaaggaagatgcaaaaatatcaagtgattttttctggtgacagaatcataggcaattaattgttatacttttctgtattgtctaaattttccacaataagcatgtactactgacataaacagaaaaaacaaacattattcaaccaggcaagcattaaagaatggacattgggtacagctttatttatttcttttaggaattgcaggttcctaacaaagtaggggtgaggggggtgttacaaaccagtcactaggcaggaacattagactccaaaagcagagaaatgcttaattttcttctacctgtttcaccacattcatgtagaactgtagtaaaaaagatggtgaatcaggctgaatcaatctaaataacaacttaaggctcccaaatcacatgaacctaggaccactaaatccaatgtcagacgtgtttaaatggtgcactgctctacatttttctattatgcaaagagctagaaaataatggtagtgtcattatgacattccatgaaaatgaagaaaatctttcaggaaaaattaagaaaataaaaatgtttactaaagaaagaatggtccggctaagtgcttttttttttttttttttttttaaaccaactgaaggccagagaaatgaaaggcatacccgtgaattaaattaatgctttaaaaaaaattgactttacttaaaatacaaacaaacgtcaactaatgaatactttattggcagaaaaaaaagacaacttggctggaaatgctgagtgtcttggactggtctgaaggaagaacatctgaaaggtctgaatgtcaaagtcagaacagtctctggtcaatcctactttgcttaaaatccaacattttacctttcttcaaattcctcaagactaaggaaaacttggttttataccaagaattatgaatcaacctacacttgctatcccttacatcacattttcattctagcttttctgaaacacattaccagataaatgccatataacctaaattcacctcaatgctttcattttgcctttacaattaccttaggacagatgccaagtttttataacttcaggccagaaaatcctcaagtggctcacctaattgtcagaaagtgagtgagtgacaacagacctcaggcacgaaactattttcagcaccaattacactgtggggggttaccagaacaagaaaaggccttcatagttctaagtgaagaaagataaaaacattttattttggccaggcgcggtggctcacgcctgtaaatcccagcactttgggaggccaaggcaggcggatcacctgaggtcgggagttcgagaccagcctgaccaaaatggagaaaccccgtatctactaaaaatacaaaattagctgggcgtggtgatacatgcctgtaatcccagctactcgggaggctgaggcaggagaatcgcttgaaccctgtaggtggaggttgcggtgagccaagatcgcaccattgcactccatcccgggcaacaagagcaagactcagcctcaaaaaaaaaaaaaaaaaaattgattttaggaggctgacaattacagttcatttcctaagatattccagacaatcactggttggctgacagaatctaggtgacagctaagatcacccctctgaaactcccttatatttggttaagcagaaatctgggctagcaaaataaactactagaaagtcagggtctggataagaaacagtgaccacattaaaggctgacggattaataatcatgatgttgccataaggccaaagtcataaagtactaatgctcaagacagataaacaacgtaagccccaatttcaagatgataaacttcaaagtgtattttttaaaatgcaagttgcctgtatgaaataaattaaaaatttatatgtaatttcagtgtaaaacaccaaaaccgaacattaaaactgttcacagaaaatagaaaaaaaaacaaaaaaacaaatcacaattataaaagcacagagatatcagttataagaaccaagtaaataaactaatttctattaatattttcatttactttataaaactttgttgattaaattgggggagtctctgacaatctaaagggtaacaaaataacaaatatacatcatttctttataagtcataccacacaaaccaagttaagttttttctatctgattacagagtcaataaatattgcatctgtatttagagcagcaacataaaactttattagaaagaaatactatatctggaccaaaaaactgcaacatggtttggaaatctaatgactaagaaggtaaaactggcaactatgtgcaactactgctcgtagatttgggtttgtttcccccccaacatctttaaaataagcagcccccacaaagggataatccattgaataaggagacaatgtagccaaagaagggatttgtggaaaaccatatgaatttaaatcaacataaaaagaacacacaaaggccatggaaacttgagaaggtgaaagaaaaaaaaaaaaaaccccaagcaaggacaagtcagctccttggagctgcaccaactcttaagtaggatgtccctattctaacggaaattgatgagtccacacctgggcacttcagtttgagaaatcaattggttggactggccattaaaaaaaggactttgtttttaaggtagataaagcttagagagagaaagctaaacagaaaagtaccaaatccttgtgaactcaaaaatgatttaggaagtcaaatgaagcaaactaaaaaactggatgaaaatgtttctctaagagtaaaacccagttttctctgtgatttaaaatcaaacaaacacactatagaagagaaattttcaaagtgcacccaataaaacctcagaggttccctggagtgtttggggtagcatggattgagacaggaagtgggttcaggcccatctcccccaacccttcttcactttaattcaaacatttctaattctcttttgtcgtttgtagtttcaggtaagatatcattttaaaaaaatgaaaaaaaaaaaaaatctaatgctgtccctttccctaagtttgaaaatcactgctgagactgaaattacattggtgagaaatatgatcatcataaatctaaaacacattttctatgtagtgctaccaaaatacaaagtttcatcaaatatttcactactattctgtaaaataaatgagaaaattaagttgttgggaagaaattaaattttgttattaccacctcccaaaatctgctcttctgctggctccaagatatcaatatttgatagtgtgaacaaatttctaacaaacattccagtcacaccgtaccccaaagacatttcattcaatggctgcatagtttcttttttgagaaggcaagcctcaaatttatagaaaactctagaatgaaaaatgtacaattactaaaaacataataacacactttatgtcagggcagaatctgcatagtgcttttaaacataatcaccaatgaagagtagccaaatcccagaacttcacacagcactcattagcaaacaacgtcaaagtgtaaatgataagcaggaaaaaaaccaagtaacacgaatgccatttttctttgatgcaatcacgaagaaaagtggaaatgcaggacgaaaagtggaatccaagctttggccacgtactgaaacttcattacttcaatgaaacagagcaaatctccatggaaaggactcattcagcaaacattaagttctttccatatattttttttccttcacgtaaggttaaacagaagttgctgtcattctagaatcagtgattacaattttttttttaattagaaaaaaggttacttgaatatttacataattttattgctctttattttaacaaaaacttttttcactgatttgtagactccatccattaacgtatgaaagtgaaatccatctctcaggaagatacagttatggttgaatgtatctgatgctgagagtacagcataattaagaaaaatccttgcatgtcatttggttcttgttgcagtcttctgtgttcacccctcagaaagcaaaagaatccatctgactttcaataaataccaaattattaaaaaaaaaaaaaaaagaacgtttccacagactagagatccaagaaaaagcagttctgatgaatgattcccagaatcaagtgagtcctcctttagtccaatgagatgatgtcaggaatgttacttccactgctggttatgacccctgtctcactcctgctgctggatgaactaacatgagtactgctttcatgggagctggtggtggtgacagacgtactgcttgctgttaagggtgaggtgagactatccaaaaacataggaggacagtactgcttgaaacaaacaatgatgccaatgaggaagaggctacttgattttaaataaagagactagaaattattagatatgcacaagcaatagtcacatatttaaatcccagtgggatttaaaaattgctcaaaacttcacatctttgggtggaagatagcatgaatttagctattttacattatttagagaatgcagcatatattcttgattctctctaaacttgtggaacttgtttgctgaccacatacaaaggtaaaagtacaatgtcaacaataactgaagtcatttaatactaaatattggccctaatctcaaaaagaatttgctccctaactgtatttagttgggtgtcaattttgaaagaattgttgatcttacaccagcatttttgcttaataacatttttaaaagtatttgttagcctttcccggtatggattgagtatcaaacagatcctttatgaatgttaaggctgaccagctgaatgatggcattggactcctttgtacataaacgtaaaatacttgtgtcatcagaatgacaacattcattctaaaacacagactacacggtagctagctatcacaggatcctcaggacagaaaattatctcaggtaatcaccaagttttgcaataaatgttaaagaagatctaacctaatcttctcgtgatgcctgcttaacacccctttcctagtgctcatatttcacaagtccccttacaatcctggttactgatcccattactgatcccaaacaagtacaaacctgaatgtactactctaatattaacagaggagtgaagagagacaagccaaaagcattatatcagtatagaatatttttatgtgagaaacgactgcactgactttagtaaaacaagaggtctagtgatatcctgcaagagatggtttaagtttgtcattagttcaactgtatgaaagatcagtaaggatatctgattcatattccccattctaaagattatgcagcttatcattagagacactggattatggaacaggaatttaagtcaagttgtttagactacatgatttccaaggccggtgaataaaacaggaacaacagtcccaggtttaagttgccagccagagggacagcaacaagtaaaattcagactgctcttcaaaagaacaagttatttaatgctttggatagataactgttttggttcatcaataaaatgaatgccacatacagagtcaagggacattagttacagggagaacagttcttaaagagcttccaaggagctctaaagatggttgaattgtccagtattaaaactcttttctaaaatcaaatcaatttctaactttccactaaaactggggggtaaatctagaacaaagcccagaaacttacattttattcctgctgcctctcaggtagtttttgattgccttataggaaaaagatactcattcatgaaagttgtgctagatgctacagtgctgccatcaacaggctctgtgcgttgaattcttagtagtattcagattgcagccacttaagttctaaccctgcatccctaattgtagctacaatgacaagaattaagggataatatggaggtcaagtagtaaaacctaaggattctatggcaaactgaaggccccacatcacccttctactactgactcaccaaataacttagaccactactaaatatacaaaacagagctatgaaataaaaacctctaggttccaagataattttttttaaaagaactggtcacataaaaattagtaatcctcacatctgaagaatccatttcctagaaaaatacatagacactttcactaggtaccttcgttatatatactgctgtaatgaggtcaactccgaatgataagaaattcctcagtctgcacattaccttgggcccaaatttctgctgctgttcatgtaatcagatacagagtactgaaacaggaggctgatacaggacttgtgcttagctgactgagcagcccatgaagcagtgacccgtggttcttcctctatccctccctatactcaactcctctcaaagtcttttgttctatgtcattttctcccttcacttttctcatgccttctcctcctctgctctgcctctgctataagcctgtctgtgcaatccaggctcactgcaaggtcttcatgttgggacaccgagctactagggtttctcatctttgacagagaaaacggggatgattgacatatagcaactttaaactggggcctccccaaagtccaaatctgaatgtctttaaaaacaatgaagaatcaagttaatgagtcaagtctgtctaatcaggtttagctattgattttctatatacagaatgttttagctaaaaaataaaactgtatttgtaaaattttaacttctagccacccagcactgcttctattcattctaatcattcaaatgcttgtaggagatgccaactgattaagctaaataaaacagaatttaaaatttagatattaaagacaaaaatcataaactgaaaacaactttattccttcaaataaaattgtgaaatatttgcacagtacttcctttccatcaatgtaagtaattcagagatgactgtcctgattttatgcaactggtcatttttagttagtatgacataaccaacaatcaaatacaaattagttgcttaaattcaggatacatacctggggatcaactggaataagggaaagaaaatccaaacctaaaacaaaaatgctttgttaatagttgtctcatattttgggagaccagaattatttccctaaatcatctttatcacaaatcacaaaacatttgtggtaagtgcttaccactctgtcacagagaagttctataccatgatcagtgatatttgaagtgtttaaaacccaaagatgaatatattctctgataaaacaactggaaaaactagctcccagagactcaaatgcagaagtccaaaactttccagtgaaggactagtcaaaacaaatatttccccctttgccgcttaacagaatgagaagcaataaaaatgatgagctaatgatctggatttgaaccatctaaaaaaaaaaacatacttaagctcttaagatatttcacatttatttttcagaaatacagaggttcatctaagtatcgcttcttaaacagatgtctatttcaatgacagctctctgtccccgctgtccccacatcaagagcagtacatagtccaacgctctgcacaaagcacacactcgggaattgctgcgctaacagggttatcaagggttactgggttctgagctaatgtaattttctgaaccagagaactgtaattgtccaattcgattttagaaagaggaatgtgtaaaaggttgtccagtaatatacttttgacatattcaagtaataacaataaataaaatttttaggtctgaaaagtctagtaataaacttcaacatcagttcacctagacctccctgtgtgactaaactctctttaattatttcaaaacattaaaaaagaaaccataggtcattaagacaggccaatttctattcaattccgtgaatttttatgctggcattcagagacaccccgaatataaccaccacacagagaaagtctgacattatgcttttatgcaaaatagagaatatcagtgggtacatttaaaatatctactaaccagtatgaatttataactcaaaaaatttaagtatatttattctcttataatctccaaataagggtattacaaaaatgcttatcaagtgatacaagctatagcaccaatcatttgaaagaaatcattccaacgatttctaaagcctttttgaaaattgttgctacagattttttttttttcctttttttgggagacactgagtctgctctgttgcccaggctggagtgcagaggcacaatcataggtaactgtagcctttaccttctggcctcagcttcgcaagaagcaggagctacaggtgtgtgtcactatgcccagctaattattattattattttttttttgtagagagagggtctcgctatgttgcctaggttggttttgaactccagagctcaagtgatcctcccgcctcagcctcccaaagtgctgggattacagacataagccaccgcacccagcttgctgtaatttttcatttcatatgtctgtcactagctatatgacacagtggtttgagccaatactaaaccaaagagaattacaacaaacttttccaatgacttctctattaaaatgataataggtgagatatctcaataagcagattttgtcttcatattaataatattcaataaatcctctcccttcttatgccaaacaattcaaaatttgtctagcccttgtaataccttcagagttttgcattttcaatatttctattattaagtaaaaaaagtttattggaacattttgttctgcttcaaatggtataaccgttttctttttacagtaacttcttatcttttcagtttttcagttttcttcatttttacaatagcttctacctttttatagtttttcagtttcatatgttcaatcatctttaatatttgctgtatctctcagttcatgttagtaactgaaacctttttataacgctaagtattgacaatggtgttggaatattgtgtactgaagccaagccactcaaaaatgctcattttctaaatgttcaactatttcaatttcagaatttcaattaaaatacgcaagcttgatataaaacagtttgaaaattatatcaagcctatttattttaattgaaattaaaaattgaagctctatcaccagagaatacccactgaggatcctatttttgttatttcaattccagttcttcagatgtactgtaattctctttgatgatttcatgtgtgtggtaaatataaagtttatttagaaaacaattaagagatttacttatctgtatattgatacctcatccacggaaaattgaatgtggtgacttatacaacaccataataaaatacctagaaatttttctaaaatattggttggaattctagattgtttaccaagcattacaagggtgctgtctatataaaacctgtttaatgtaaatatttctctcactgaaaccatttttttctcaagtactaacagtgaagtttgatatggtattttagatgttattctttctaacaaaaaacgaaaccatcaaagtcttcttgcattttacattttaagcagaatattaaaactcttatataaaatcaagtttcatcagtagtgattaaaattttactgccttgtttcgtaagtttagcaaaatgctgtttcttatttcaccataagtttcaactgcagcgtgtcatactgatatatttttatgccctccgaagtatttcatggttgaaaatgctcaattacttttaactaaaaagcaggtagtgttaacattattttattaacactgataaaattttaatttaaaaattttaagtgcttcactgtgaaattgactcattagattttttctcattgatgacaacacattttccttatttgagtcataaacttttaacaaaacataactgctacatgattaaatatgtaaatgtttagcactttcaaattttaatgatacaacttttgagcaccattcgcacctgacaatatggcactagcaataataaggcagtcatatttttccttgaaataagctgttttccactccataaatacaaattatttgttttattttgtattcactgttgcacagtatcagaagatgttccaagcttcagttcattattaatatcatttcttctttgttctcctgcagattcagaagattcatgtttatgatgtttaaaaggaatgttaagaaatgtattaaaactttgttatctctccattcttggtgttctatttaatattttattataaattattaagtttatcaataccaaaactcttcacagtatgactaactacataaaaattatgcataaaaataaaaccaaattactaatcacaaaagagcacattaacaataaaatcaaagtaaaactaaactatttagatatagtaactgctacataattcatacatgatgataaactagcaattcttctaaagcaaaatagatcctattctattcagttatcaactggtaagaaagcttttcaataataacaaccagtatcaccataactgttaatactggctaaatatcagccttggatattagtcttgtttgctcaatatcagcttgaaacacatttttaccaaatagccagttcagacatattttactgcatttttctcaagtttgcacatttctaaaaagaaataaagtctcactttatgcccaaattctgaaataatgtaaatttcccccaattaaaaattaatccaggttcagagaactgaaaaactaacagggcaagtgattggtaaattgtgtctatgctactgctaaatggtaggatcactttaatgaacagaaatgctcattaccttttttcaggattaatttttaattcaaggtctttaggaaacaaatcctttcagaatgcttgcttataacacatactgagatgacatgcagacactcttccaacaacccatgttacagccataaaaggcagttgggaattaagaatctctgaatttccatctttgtcaccgacatgaatcctcacctgtaccttggcattagactttgtatatactttacaaatactttacaatttgtgctagctgggtctacaaagaacttcttaaaataccaactcccaaattacatgtggagtaactatatctaagaagcaaagaataactttaaaagccatttttttctatggatactataaaatgtctattcttttccactaaattttattcacataatctaaacaaatttcaagtggcaaaattataccgagccaattatcaattgtttcagtaacataaactttcaccaacaggataagcattgtgcttaaaataaagacctcactaaggggagaaaaaaaataaatcataggtcaaaattaacttcataaacctagagaagaaaactagtaacaggaggagagaattgtattccactaaaagggccttcggagagaagggaagtcatgaatgtactggttctaacttgctcaaatataattgacagaaatgtctgcaaaagcaatagctatggagagggaagaagagtaaaggagggaagtttaaattttgtaatatggccttggttgcagaagtcctgatactaaggtaattctagcaaccttaatattttacagtagattcccccttatccaagattttgcgttctgtgattgcagttacctgtggtcaactgcagtcagaaaatatcacatggaaaattccagaaataattcataagttttaaattacacactattctgaatagtctgatgaaatctcatgctgtcctggctccatcatgctccatcccacccaggacatgaaccattcttttgtccagtggctcccagctttgtcactcagtagccatttaagttaacagattaactatctcagtacacagtgcttctgttcaagtaaccgttattttaacttaataatggcaccaaagtgatgccagcatattgttataattgttctattttattattagttattgctgttcatctcttactatgcctaatttaaaaattcaactttatcatgagtatatctgtatagaaaagaacagtatatagggttctgtaatatctgtggtttcagacatttactgggggtcctggaacttatcccccgtggataaggggaaagtactgtacatataaaagatatcccaagtattaagccccactctagggaaacagatggtagactctatctttgtaaggagaataaaatccacagcttgtaggaaaaatcagccccaaacaacatcaatatattctgaagttctgatgagctaccaagaagagtatgagaaaatattctcccttcacctgtgaggttctataataaagaaaccaagaagaagtctctaagtacaaattcttcaaaaggaagaataaaatctctaacatttcctattctactatatttcttatcaccaggaatctatagattgctctgtagttaaaataacaactggatgtgatgtataaaaacagataagacctttacccgaagctttcaaatttccttagcacctctactgaaaatttcaaaactatactggcttcacagattaagattaaaaaaaataaactttcattaaaaaacaaaagaaacaaaaacactccacatacctggcaaatctgatgacatgcttgatattggcgtatggtggaatggtactgagtagtctgttaatgaaggcggaatagcagcaggatcaaccgaagtcacactgggcacccttacagaagatggctgatacatgagaaccctgttttaaatagcacgggaaattacaaacaatctggctgttagttcacaggagagaagagctgcaccactgggcattctcagtcgttcgttcaccagtttcagcacaactatatggcagctactcactacacagcactccactctactctcctctcccataatagtcttcattttaacatgaacatatcttggctctcaacagcagctgcgacataagagcaagttgacattcaaacacaatgtacagtgctggagtgagatataacacttccatccacaaatagaaatagacatcacttttattaatatgtatgtaatatgtatatgggtatcagtaattttatctataaagaaatttaaaactaacatagaagatccctaaggtttgatttaaatcagggaaccttgagaagtgaagctactcactgtagcacaatccaaatttcttcaagtctaactcgaattgtattaattatttgcaatctttcctgggaatcatctgagcaaaattacccaatcttaaagccgaccaacttgatggcaataggccacaatcagaaacgaggatgagtgttcaggatttaaaatataatatccagaaataaaaatgctggctaccatgatagcacctaccaggtaggtgaaatcctaagagagtttatgattttaaaattagctgttcatgctaccaaaaatacaaattaaacatatgtaataaatacttcacaattggtattatataaaactgtatatacactatagaattactttataatttcaagaagcagtataattaaacatacttttgaaaaagttcaagcttaaacagagattttttttgcattcttcctatttaacctgcattttctcttagcccagggtaaacaactacaacttcacaagaaagacatccttgaatgtatgtaggaaactgagcactgttactggtcttatggttgatggtgggaaccatggtcacaaagctagactgggataacctctgggcatcctttccctttcctgttattgctgattattaaatatcagtaatgagaaatgatgacaaattgcatgacattctttgtactctggaaaactatttcataacctcaatttaaatgtcaaaccacttaaatatggatatcaatacaaatgtggaaaacagtcatcttgagagtacatacattgttgagttggcaactatgttagtctcagaaaagtgaataaataacacaggtcagagttcagaaatctttgatcaaaaactgatccatttaggaagcttatgacatataatatgcttgaggcaataacataagcctggtatttgaaaatacattttcccgaggtagataaagacagaaggaagttatcttccaaaaatcaaccacatgtctgtaggttagaatctggagatttcttggcctccagtgctactcgaagacctaaaaccacaagcagtatgtgagcaatgttagaaaaggcagactctggaggaaaaagagaagttgggaggagataaaataagttatattgtatctaaagctcatcttttctggaggtttgaaaacagtggtcctccacagggatcaaacgaacaggacatcatcaaaagtttttcaaataacatgagaccacctctcacacacaagagtttatatgagaaactggaggaaggacacagtgggtaaggaggagagagagactggggtatacgtgagtgctggggaggggactaaagaagtggtctgattattctggctgtctcaaagtattaatatcttattgttttaaaaatgttaacaggcaggcttttgaagaccaaatatatatataaagtttcatttaatttaaaaagtttctacttaagagtacatttagagccaggcaaggtggttcacacctgtaatctcaggtctttgggaggccaaggcaggaggattgcttgagctggaagtttgagaccagactacggaacatagggagaccttgtatctacaaaaaaaaaaaaaaagccacatatgctgaagtatgcctaaggtcctagctacttgggaggctgaggctgagactgcttgagtccaggaggtagaggctgcagtgagccatgaatgctccactgcactctagcctagacaacaaagcaagacctcgtctcaaaaaaaagtacatttaacctatcgtgttttttttttctctgccactgaaagaaactaaaagactttctggtacaagaaaaagctaatgaatgtctttttcccactcccccttctcttcctttgctatttcacactggagattttcttttgttttgatcctgattgccctttcaacttgaaatagacttacacgtaacaacaataacagagctccctttccttccctgaccctttgacttacatctataaaaggagtcaagtgaatgtacctacacacctgtctgtcactacagtaacacctaataactgtacgtgtcctgtcacttagtaacatgaaactttaaatgagtaaatagctactccttacttaggcaacaccaaaaggttgactgtcaaaacatgtgaaatgtgaaaatccaatggcggtacaaattagtaaatcaacatctaaaacctcagcaaacatatgaaaagctaaactacttagtgttggttaattcccattacctgaatgttgcaaccattaatacaaattcaactttacatagaatggcttaaagtagtcattagttaggattatcaaattacatactgggagcaggcttttgttatcaaaatcttcacaaagaccacattcagaaacaaaatgattctaaagcctatgcaaaaaatagatatgagtaacagattccatgaaaaaatgtaaatggctatggatggtgaaatgatggatgtaaaaatgtgatgctatatgttaataaaaagatttaaagcttttaaaacttgttactgcctcttcataggattggtaaacacacacagatacgtgtatacattatgcaagtgaccatttatattttaaacgtttgtaactttatccataatatcacagcacaaaagtgaattgctagaatgctgctatatagcaaatattagtattccggattatatgctggatcagagaattgcatgaaactcacatttgctcagacttggatgtctgaaaataggttgaccatttctatttataaccctgaagttcactgtatgctcccactttatgatcataaaagtataaaaaagatgcaattttgctaccaattcttaatgattatcaatctggagacatatagatttatccttattatgtttcctgtctttagaataccttcttattaaggcaaagcaaccactcatttttcagaaggggcacaatatgtaaaattatcttttaatatggaaaaacatcagaggttttctaaatgtcttaagattaacatacaagtttcttctgacaggtattataagactgcatttaaagactccggttcgtaagcaaagaaagggaataggactgccatcaaaatggcaatgattctctctaggtgagatattttttgctttcttcttggtgctttgtaaaattgtttataagaataatttttactaaaataataatacctcttaaaagatagttgctcacaggccaggcgtggtggcttatgcattttgtaatcctagcactttggcaggccaagacaggtggatggcttgagctcaggagttcgagaccagcctgtgcaacatggtaaaaccccatgtttacaaaaaaaaaaaaaacacaaaaaaattagctgggggtggtagttccagctacttggagggctgaggcaggaggatcgcttcaacccaggaggtcaagactgcagtgagccgcgatcacaccacggcattctagcctgggtcacaaactgagaccctgtctcaaaaaattaaaaaaaaaaaaaaatagttgctcacataatttcggggctgtaaattagagtaagttttcctgatttctcattctctgttctttctcatttgcttactatctttgatggccaagaaatcctatgataaacttacacagcacaggaaaaccataaaaactctagatgctgaactacaagaaaggatatgaaaaggacaaccaagaacaaagtcacaaaagtctaagagtaggaggggatcacagagatgatataactatagcatgagcctccactatgacactgtgacaggtggcagccactctaacacagaaaatatgattttgggacaaaagattaaatttcctagtattcagaaagctccaatagaaagtttatccatgtatctttagtccactggacctaaatctggtaataaagaacaaacttaatccagctagtcattgtctcccttttaagaactacaaggtgggtatcaaataatctcttctcctggtttaacagcttcagtccttaagatccactcatccatcttgctccagattccactattcaccttcccgttcccctgctctggccatactcatttgttaataccattcttgatgatcagcactgactgaaatgctctgagagtcatatagcctaaaatggaacaaaactggcatggtatggatcctggacactatgcttattttattaatgctaagaacaaactgatttcagtggtgaactcttcaaaccattaactgaaacctgacatttgaaagagtttctatcagaaatggcaattaatttactgaaggcctttccaacatccatgaagatgactacaaagttgtccttatgacgagatccatcttatcaatgtatttcctaatattaaagcactcctgggataaactctagttggtcacagatgtcattttaatatataattaaatgatttcctaagactgaattcagaattttcatttatctttctatgtgagtctgtttcttaagagttcttccgtgtattaatgtgtatgtatgtctaggttgggtgttaagggctacatcagcttcatggaacgaactaggtagctgcgctttatacagacttttaaaataaactttcatgtgttgctggtttagtcacaaatttctatcttatacttaccaatgttagtttttgttttcttttcagcctaaatgaggaaccttaacatttatctctatagtagctgatcacagatgtaaactatccttattcctctgcatactgaggtcatttcagattttgtcgcccactgtgtatgtgccatccctcctgtttcatggacttatcaaacacagataaaaatgtagtaaaggacagagggtagacccttgtggcatgccaccagagacatgctccaagatcacaacaactcatgagtcagcatcactaggcatgacctctcaacctggcatgaattcagccaactgcagtacttgcaactcatgtttttccactatattctaaagcgtatcattacagagtaaaatccagaaacatcacatctaagcattcattccccttcaaaatacattttgaacgtaaccatttcaaaattataacttcattttctgtttatcatttaaattacagatgtaccaaccaatttgtctcaaaggagcaataaatgattggcacaccaggaaaaaatccacttgaaatacttcctcattttgttccacacacacaaaaaccccacctcattctaattaaatgggtagaagtaaatatatgcctttaatatatgtgtaaattatatttggaaatgtaagtattttaacagcaaagaaggcagctgaaaaggtttaattcttaaaattataaaaataaacaatgttgcaaaacaagacattttatataaaatgtctaaacaggcattatagacacaaaaaaacgattgcctagatttggggtgtaaataggaataaactacaaaagaacatgaagaaagttttttgggtgttgaaaatattctactactgaatcatggtgatgattgcacagctctatgtatttactaaaatcactgaattgtgccattatatacttaagatgggtacattttatgctatgtaaattataactcagtaaagccattagaaaaccaagtggaccaagaggccaaaaagatgacactagcaaacccaagtttgaaagaatgtgttcgtagacagccaggagaactctcctgttatctccttttatggttcaaaacctctctgaaaaagcaactattgttaaatacccaaacctgatttttaatgcaggtcagtaatgccttctgccagataacttacagagaatccacgctaaaattcaggtagaatgccatcctacccacctatattttgccctggagagggtgaaaagggaaaggaatcaatttttattgggaaattaccacatgcctgacaccgaggctttctttcatctcattaaaacctgaaaatgatcctgtaatataggcgttatttagctccatttaacagaacacaaaaaagaggctcaatcaaattaagtatttcatctaagatcacagaacaagtaagcgatggtgtgccaaaattggaatccatacttgtcagattcccagttccacactccattacaccagactttctcatctggtctgagatgccaaatttccttacaaacaggttcaagaaaataacaaaaagtctcaggtaggaaataaatacctcacacgctcactttccaaagatgtaaatattttctccatcaaaatttgcttcctataaacaatgtgcttactcgaaaatatttcaactcaacaaaggcaaattaaaatagccttctacagttatgccatttcccaaagagacatttataaatctatccaagagcaattagttgcaagggtaatgaacaatagtgaactataaattaacaaaccctttggttgggctgctttgtgtttctgacataaagatgcatttccttttggcaggagggtcttcctcttcgtcagaagagctttctattgtaagatcaataacatctactttcttcttgcttgcctcactggctacagtcactgaacaaggcttactgaggacgcttgaacctgcatgtaaagaaacaaaaggaaaaaaaaattaaaggtataacacaaataaactctagtggtagagtctagtatattcagtatagtatgttcctgacaacatatagccagtgaagccacatactccaacccatggacaaataccaactccctaactccagacctctgtctgtaaaatggttgttcacctagggagacaggtgagcactattccttgacagatggttagaagtctcattcagacagaatgttcttagttatgcctccaataccactgaaggatttgtgcagctcctactgctcatcctgtctctgcaggtcagcagtcgttttacagaaagacacgcagagttagggaactggtctcaggtcatgggacaagaatgggtgagttcaacagctatgtattctcgcacacatgtggcacagttagctcagaaccagatatttccattctagcaattatgcttatatcaaagaaagtacagacttttcaccataagccagaacttgataaaaactttcatcttgataagttgaaaaaaacccaaacctctcaattaagttactaagacatttaaacttttcttatgaattatctgctaatcacgtaggttctttctacccacaaagacagtctcacataccatatttgttaactcacattttcacagaaaagtatgttattatctgtaatgtatttagttaaaaatgaatgacagttgataatggaaaagcaacagaaacttatcaactaaatcactccccatttttctgaaagatgagagaaaccttggtcactgcactcaggtttagtgtcaatcgcagaggaataattaataatggcataaatcctttattttttcccctttcttcttactccattcattacattgtttgttagaacttcaaatgtaatcagaacaaaactgaaatgcagtgagtagactgttagataaaaagaaactctaagttcacgtgtgggtttcaatgagactgttagataaaaagaaactctaagttcacctgtgcgtttcaattactccaaatgccctcagtttccctacttagtgtggatggatgcaggcagttgatggatgagtatacattctaggtaatcaaggcaatgttaaaattcttctccacaaagaaatggaaggtaacaatttgtttactttctgagcaactaacctgtgaccatccccaaaccaccaaggccattaaccaatgatgcagcctctctaacctcacctccacctagggttccacctacagatactctaagaacaattctgaaaaactgtccatataaattcatttgtgactttttgttttgtaacaaacatcatattttaaaatgattttagatgaatgtttcctttattctacacaggaaaaatatactatgaaatagctgataagatggtataaactttagcacattccttcaggaaagaataaaaatcatttgggggaaaactatatatcatcaaaagactgagtcaacaagctga

SEQ ID NO: 133 - DNA, 27824 bp, Homo sapiens
  source 1..27824: mol_type = genomic DNA
tctggtgatgtgtgaaaatttccacaatgaaaaattttaaacagtggctacaggactttttaaaattgggagtgagcaggagaggtatagaacctgctggaaattcacgcatgtgtgggatcagagctatcttcacagagcaggtttcaatgggcaaactatagggggaaatgataaaataatccaattgttttctgagtacaccctgtgagatccacttgtccagcgttctgcttattttttctgggtggttgaatttatgtgttcccatcctccattcctagagaatgccttctggccaagacttccccagtgctcaccccagcaggatctaggcagttctgtggctccctggcttttttgggcgatctgacgacatggcagctccttgccacagacaccaagatagatgtttccggagtgcagagccctgggggtgcggaaggacagcctctgtgaagatattcagcacagcaggggccattagtcaccaaggatcatttgacattttgaaatgaactcccgggctctcctaagtaagctggaacactgaattatgcctaggctagtggctgtgtctggggctgagggtccccgccaggaggggaggctgggtgcagcgcctcaatgccgggaagtgagcagcatagcgcatgcgcaggaacctcgctggtccgcctgtggtctctcagctggggtcacagctcatggcagcttcagcggtgtgggtgggtggcctcgcttaccatcgacctttgtgacaagccttactggctcttcttcaggaacttgccaccgagtatcagccgaaacctgagtccgctgaggcgtaggccaaaggcccctctagctgtcctttctcaggcccagaggatgctcacggagaaaagccaccattcagttgagtccatctctggcaccaaagctcacaatgaggctacgccgaggaaactggcttttcatagttagatttggttttcttccctgagcgtgacagccaatactttatgaagactccctgaatgctgggcattattcagtgcttggaatcatgtaatcctcacagcaaccctgtgaggaggggctttccccgtccctgttgtatggatgagaaacggaaggcttgcagaggctaccatgaagtgacttgcccaagggcacacagccggtgagttgtgactagtactcaacgcagccacaaaagcctggctctcaaccactgatcctgcctccccgggagctttaggaaactaggcttattacaggttccattcaaggcagggatgggcggggttcccagctgaggccctggagcagtcctgcagccttacatttcttcagagccaactacgtgtgggacattccaatccaggtgtggtcaaatgaggccctgtcatgcaggggttcctgggtgacttaggggaagaatgatttttttttttttgagacagggtcttgcttggtggcccaggctggggtgcagtggctcaatcatggctcactgcagcctcaacctcccgggatcaaactcccacttcagcctccagagtagctggaactacaggcacgtgccaccagacccagctaatttttgtgtttttttgtagagaggggatttcaccgtgttgtccaggctggtctcggactcctgggctcaagctgtctgcccgcttcggcctcccaaagtgctgggattacaggcgtgagccactgcacccggccctggaagaatgatttaagaatcatttgtgatggcggtcaaatgtttattttgaaatgccagagaatagttttctaggcaaaaccttccctctgcccaggtggcgacacccttcatttgcttagcaaactctttttccagtggttctgcaaaggctaccctgaagaaaaggaactagtaatgcctaacactttcgagtttacaaaatgctattccttacctgattttgctttgctccgtccataatttggcaataggcgattcagacccattacagagatgaggaagcagaggcttccggaggcaaattgcttggcagctcagccaggactcaaagcacaaactctagtttggactacccagtaggaagaaatggaaagggaagagagatgccaaactgatgaggttttagtgaaactaccctgtgtttcttaggatgtgagtggctatttcttgggtagatttctctcaagcacagttcctctgtcctttcttgtcgtgcccagacccctgccctccgctcctcccaggccttcttgctgatgagtaaacaagatactttctggtcacccaccttggaaaatgagggctgcattatagccggactccccctgagtaagcataagtctgggctgggcacggtggctcacatctgtaatctcagcactttgggaggccgaggcgggtggtcacttgagatcaggagtttgagaccagcctggcaaacatgggtgaaaccccatttctactaaaaatacaaaaattagccaggtgttgtggcgcacaccggtaatcccagttatatggaggcagaggcaggggaattgcttgaacctgggaggcggaggttgcagtgagccaagaccacgccactgcactccagcctgggcaacagagtgagactccatctcaaaaaaaaaaaaagaaaaaaaaaaaagaaaggtggatctgactcttccaggatcacacaggtctaagaggtaaatccagattttctgttataatcccaaggtcattctactatagccctaagacacacaggtacctctctctttcactcctaaagcctgtgcttttttttttttttttttttttgagacagagtcttactctgtcacccaggctgaagtgcaatatctcacaggttcaagtgattctcatgcttcagcctcccaagtgtctgggattacaagcacctgccaccacgcccaactaatttttgtatctttagtagagactgggtttcaccatgttggtcaggctggtcttgaactcctgacctcaagtgatctgcctgctttggcttcctgaagtgctgggattacaggcatgaactattgcacccgccctgtgctgtcttttaagattcattggtgaggccgggtgtggtggcatacgtctataatcccagcactttgggaggccgaggtgggcggatcacgaggtcaggagatcgagaccatcctggctaacacggtgaaaccccgtctctactaaaaaatacaaaaaattatccaggcatggtggcatgtgcctgtagtcccagctactcgggagactgaggcaggagaatggcatgagcccggggagatggagctgcagtgagctgagatcgtgccactgcactccagcctgggtgacagagcaagactccgtctcaaaaaaaaaaaaaaaaaagattcattggtgaacgagtacattcatttgctaggaattcttggatgtttgtttacaaatgcgtatctcctcaaccagactctgagccctttcaatcaactcaatacattatgaaacaaacaagaacaatgcaagcagactaaaaaaaaaaaaaatgtgcatcttgtccccgagtaggaactgccccataaatctcctgatcttccaatatgcccgttctcccctgcacagctagcaagggttctggggtagggtttctgtttccaaaagtgcctaatagggacatgcttatcattagttctccaaatctggggaatgctcatttgtttgcctgtgcgaaaatgaatgtatagtttacccaatacacacacagacacgcacacacacacatatatgagttagtcaagcacagagaacaaaatttggagaactgccagatcatgaagagtgtttaatcctggggtagggccaaaatgtcattataggcaattttcaccttttgtgaatgcttacagcttattcaaaaaatattttcaaaataaaatattgagtatgtataaaagaatatcaataaaatgtaagtaaggtatgaagagttatgatacaatagacactcatatactcaccacctgggcaaagaaatagaacacagtactatttcctctgaagtcccctgttagccctccccagtgccatccctgccccttagccttcagaggtaaccatgtccctgaattctgtattgatcagtctacttttcttttagttttaccacatatgtttgcagcctggacgagcttgtttcattttgcatttttgcatttttacattttcaataaatggaaatatactctaagtacttttctgcaacttgggagattaatctatattgttgcatatagttcattcattttcagtgagtacagattgttttcagtgctatatagtattccattgtatgaatatattataatgtatttaactattttatcattgttggacagctgcattgtttacagttttctttttttaatattacaagtgaggctattatgaacatttttgtataagtctcatagtgttacacattgccattgagaaaaatatctgagagaggaatttctggtcatagagtatgtacatatttaactttactagatgatgtcagtcttccaaagtggttgtataaatttatactcccaccacagtctttggaagcttccattgatcctcttcctcatcaacactcagcaattcttgttagacttcttaattttagctgctgggtgggtgagtaatagtgtctcattgtagttgtaatttgcattttgctgattaccaatgaggtttagcacattttcatgtttattggccatttggaaatcttttctgaagtgcctgtcgatttaattttttttttctgtttgtcctctggtgctaaaactgaaaacatgttcaatactttagtctatttttctactgggtttttgatgtcagtttttggtaatgctttctacatcctagagatgggacctttagtatgtgcagcaacgattaccgccaattcctcggcttgccttttcattctcttcgtggtgtcttttgatgaacaggagttcctaaatgtaatgcagtcaaacttagcaatcatttcctttatgttcagtactttttgtgttctgtttgtttccctaccctgacagcatgaagatattttcctatattattttctggaagcaatcttgttttgcctttcatctttagatctaccatctagattgatttttgtgtatgttgtgtggtagggtcacatttcttttcctttttcatgtggatatccatggagctattgaatagaaataagtacccttttcccactgtcctgcagtactgccttttccataagtgtgcatgtgccatagatccatctctatcccattggtgtatgagtctgttctcacattgctataaaaaacttcccgagactgagtagtttacaaagaaaagaagtttaattgactcagctccacaggctgtacaggaagcatggttggggaggcctcagaaaaaatcatggcagaaggtgaaggggaagcaagcacatcttaccatagtaaagcaggaaagagagagcaaagggggatatgccacacacttttcaacaaccagatctcgtgagaactcacttactatcacaagaacagcaagggggaaatctgcccccatgatccaatcacctcccaccaggtccctccccacattgggaattacaatttgatgtgagatttgggtgggaacacggagccaaaccatatcaattggtctgtctatgtttgtcatacagtataacagtataatgtcttattttagctttctaatgaatcttgcttcctgacagaggagatcttcttcaagatgatgttagctactcttgaacttttgcagttccttatgaattttttgttttgttttgtttttgttttttgggacagagtctcactctgttgcccaggctggagtgcagtggcgcgatctcggctcactgcaacctccacctcctgggttcaagtgattctcctgcctcagctcctgagtagctgaggctacatgcacgtgccaccacacctggctaattttttgtatttttattagacggggtttcaccatgttagccagtatggtcttgatctcctgaccttgtgatcagcccacctcagcctcccaaagtgttgggattacaggcgtgagccactgcacccgatctccttttgaattgcaaaatcaccttatctgggcctggtgtggtggctcacacctgtaatcccagcactttgggaggcagcggtgggtagatcgcctgaggtcaggagtttgagaccagcctggccaacatggtgaaaccccatctgtactacaaatacaaaaattagccaggcatggtgataggagcctgtaatcccagctacttgggaggctgaggcaggagaatcgcttgaaccttggaggtggaggttgcagtgagctgagatcgcaccactgcactccagcctgggctacaagagcgagacgccatttcaaaaaaaaaaaaaaaaaatcaccttgcctgttaccacaaaaagggaactttgattggacttgcactgaatctgtagattggttttggaagaatttatatctttacaatattgagtcttccaatttctgagcatgatatcattctttatttagttagatctttttttcagtaatgtttttatagttttaaacataggcatcttgaacatcttttgttagaattattcctaggtatttaatttttttgatgctgttttaaaatttaatttccaaactactgctggaccctagagatgcaactgatttttatactgatcttgtatttcaaaatcttgctatactggtcctttctgcatttattgagataatatgatttttcactttcattatgaaagtgtggtagattataatgattgattttccaaagctgtcactcttgcagtctggaaataagctccacttagccatgatacattatcctttttatattatatatcattggatttggtttgctaattttttaaaggatttcaaaaattgatattaatgacactggacttaacattttccctttttgtaattttgctgtcaggtttggtatcaaggctatgttttaaaaaaataagtttcgtacagtggctcatgcctataatcccagtactttgggaggctgaggtaggaggatcacctgaggtcaggagttcgagaacaggctggccaacttggcaaaactccatctctactaaaagtacaaaaattagctgggcgtggtggcgaatgctggtaatcccagctactcaggaggctgaggcacgagaatcgcttgaacccgggaggcagaggttgcagtgagcagagctcatgctgctcactgcattccagcctgggagacagagcgagattccatctcaataaatagataaaaataaaaaataagtttggaattattcctctttttctattctctggaaaagttgtgtaacagtagtgaaagggtttccctaaaagtaaaaacttaccactgaagctgtctggaagtgaagtgttctttgtggggaaggatttaataagaaatttaatctccttgatatatatggactatttagattttctattcttgtgtcagttttgattaaggggtatttttgttaagaagttgttcattgtcaattttccagtgtaatgcccaaagttgtcataatatccccttatcatcttttttcttttctttctttctttttctttttttttctgagatggagtctcgctctgttgccaggctggagtgcagtggcatgatcttggctcactgcaacctccgcctcccaggttcaagcgattctcctgcctagctgggactacaggcacgagccaccacactcagctaatttttgtatttttaatagagacagggtttcaccatgttggccaggatggtctcgatctcttgaccttgtgatccccctacctcggcctcccaaagtgtcttttcttttttctgtgagatagtctctctctgtcactcaggctggagtgcagtggcaggatcttggctcactgcaatctctgcctccatggttcaagtgattcttgtgcctcagcctccccagtagctgggattacaggtgtgcaccaccacatctggccaatttttgtatttttagtagaaatgaggtttcaccatgttggccaggctggtctggaacttctggcctcaagtgatccgcccactttggcctcccaaagtgctgggattacagtcatgagccaccacgcccagctcccttattatcttttgaatatgtgtggtatctgcagtgatggcttctatttcattcctcatgttggttgtttggatttcaccctttctaaattactcagcagcttattgattgatttctttctttcttcttcttgtttttttgaaatggagtctcattctgtcacccagactggagtgcagtggcgtgatcccagctcactgcaacctctgcctccacctcctgggttcaagtgatgctcctgcctcagcctcctgagtagctggaattacaggtgcgtgccaccacacccagctaattttgtatttttagtagagatggggtttcaccatgttagccaggctggactcaaactcccaacctcaggtgatccacccccttcggcctcccaaagtactgggattacaggcgtgagccactgtgcctggccattgattggtttttttgaacaaataaccaattttcagcattgttgaattctctattttatttgttttgtattttattcgttttgtttttatcattactatttcttaccttctacttttttggggggttaatttgccttctttgaaaaaaaagttttttttagaagaatgcttagatcgtcaacttttagtatttctccttttcagttgtgcaattaaaggtatatatgtctctctaggcatagtgttggatgcatgccacaggtttagagatttatattacatattattacttggttcagaaatatttggttctggccgggcatggtggctcactcctgtaatctcagcactttgggaggctgagacaggaggatcacctgagatcgggagttcgagatcagcctgatcaacatggagaaaccctgtctctactaaaaatacaaaattatctgggcgtggtggcacatgcctataatcccagctactcgggagactgaggcaggagaattgcttgaacctgggaggcagagcttgcggtgagccgagatcgtgccattgcactccagcctgggcaacaagagagaaactccacgtcaaaaaaaaaaaagaaagaaaataaatatttggttctaagttactttttgatactgtctttgatctaagtgttacttagaagtttatgaatttccaaacatatggagattttataggatcttttaattggttaaaatttcatttctacagtggtcaaagaatatattctgtgacttcatttttttttggcatttgttgcaaattaatggccccaaacctgatatatgtttgtaaattgtctgtgtccttaaaacaaatatgtgttctgtagttgttgggttcagtgttctatatatatgtcaggtcaaatttgtgaatcatgtttttatgattttgactttcaaaaaactttttatttttaaatataacacaccttcagaaaatcacataaaacaatgtactgcttaatgaatttttataaggtgaatatttttgcaaccaccactcatgtaagaagatagaagcttgcaagcaagtgccctctgctaatcatagccatcatcttaccccacccgaatatctactattctgacttttatggtaattatcttcttgtcttcatgattttgtcatccaagtataaatacctaaacactacagtttaattttgactttttaaaaactgtttttatatgtctcttaatttgtagttttcctcttcttctgtctctctcataatttgttttaaaaaaccaggtcattggtagagtttctcttattctggacttttcttttttcattttttttttttttttttttgagacaggctctgtcactcaggctggaatgccgtggtgcaatcttggctcactgcagcctcaacctcctgggctcaggtgatccccctttgcctcctgagtagctgggactacaggcgcaccaccatgcccagctgatttttgttttattttggagacaggccttcaccatgttgcccaggctggtcttgaagtcctgggctgaagcaatctgcctgcctcagcctccaagggtgctaggattataggcgtgagccaccacacccggccatattctgaattttgctgattacatttccatggcataatttaacatattcctctatcctctgtatttcttgtagattagtaattgacggtagaggactaatcagaattatgttggttttgttgttgttttttgacaagtcttcatgaatagttgcttggtttttgtttttttctataaggaggcaccaaatgtctggaattccctctttatgagatttagaaggtattggtgttcaatgtctaggtgcatcaattcattcaaggttgcaaaatagtgatattatagttctatcattcctccttcattcatttgctagaatacttctagaaagagaaaatttacctcatctactatttaattcccaattgtacagttcaatagaaaaggcaagataaatgcttaattatttccctttccctaccagttttccaaatagagacttggtttctcagcaatcctccaagggtaaccaatttgaatttttgtgtgtgtgtgttctaatgaaccaatggatttaaacacatttgatgtgtttcatccattgcagtaattaccctggatgttcaaattgtcccatatttgggcagttggagtgctagttggctcctgtgtttctgaaagcttcttttccatctggtaaaacgagatgctccaggctcatcttgtacaattcttgtcccagacatttttccctgaagcagtggtttcttttagtggaaaatgatatactactatccaaatttggttactgaaaacagttggaaagattattttgtgtgtgtattctcgccccattctacttcgccctgctcttgctcttcctcttctagggagcatacagttagtatcatacgtgtactttttcttttatatccttcatgcagtctcaagttttacacacacacacatcaaaatgccattccttagcagtttcctaagaaaaggctatagaattaatatcctttttaatgttttgcatgtaattcttctgcaatattcatattgaaagttaatttgggccgggtgtggtggctcacacttgtaatcccagcactttggcaggctgaggcaggcggattacttgaggtcaggagttcgagaccagcctggctaacatggtgaaaacctgtctctacaaaaaatacaaaaaattggccgggcgcggtggctcatgcttgtaatcccagcactttgggaggccgaggcgggtggatcacctgaggtcaggagtttgagaccagcctgtccaacatggcgaaaccccgtctctactaaaaatataaaaaattagctgggcgtggtggcgggcgcctgtaatcccagctacttgaaaggctgaggcaggagaattgcttgaacctgggaggcggaggttgcagtgagctgagattgcaccactgcactccagcctgggcgacagagagagactccgtctcaaacaaacaaataagaagttaacttggctagataaacaaaaaatcttggcctttatcttctttccttgagtatcttaaatagcttactcattttcttctgacataaaatgttgctatcgaaatgttttttgacaagcacattttctttctcctgtaagttacttggtgtttttgcctatgtatccaaaagactttttccttttttttctaaagtctaatattttactagaatatgtcttggtattggctatttggggtcagtttctccagttatggtgtgtcctttagattcctttcagaatttttgtttgttttcctcaaagttttgggaaaaaaatgcattacggtttcctaactataattttggatttgtctattttttcttttagttctagttactttctacatttttgagtcaatgctgttatatacatgcaaatatagatttgctagctctttctggtaaattaaagctatcattattataaaagacctctttacctctagtaatgtttcttgcttttaaatctatttttttctgatattaatattgctaccccaactttctttaggtttttgattgctgtatcttttttcatactttaattttaccattctgtgtttcttaagcatgcttcctgcaagcaccttataattgggttttgttttttttaattaagccagacaatttttatattttaattagagcatttagcccatttatatttaatgtaattactgattcacttgagtgtaaatgttattatttactctctctttgccccagttagtctatgttctcttttctttgttgtcttttaaaaaattattcaattttctcatctcttaacttgatagttactttttttttttttttttgagatggagtttcggtcttgttgcccaggctggagtgcaatggcatgatcttggctcactgccacctctgcctcccgggttcaagcaattctcctgcctcagcctcccaagtagctgggattacaggcatgcaccaccatgcctatctaattttgtaattttagaagagacggtgtttttccacgttggtcagcctggtctttaactcctgacctcaggtgatccacctgcctcggcctcccaaagtgctgagattacaggcatgtgccaccgcgcccagccagtagttacatatttttaaaaataagatctttgttggtcaaacagatattgcaacatacttgagttatcaaattccagaaggaattagtacctttacctcttctcagacaatatgagtgcctcagaaagacattaattccatccactccacttctgatttatatgctactgctgttgcacagccacgcccagcagcctatgaagctttcaaaagccatgctcagtcttatcagctgtctgtacaatcagtaaatgcatctaggccccagaaacctgccttatctgcttgagtttctgctctccagagatcttggctcagtaatttttcactctcatctgggctctttgatgccttcaataattttcatattagtccagcttttctagttgttcttggtgggacaattgttctggtttacctattctgacattagcggaagtagaagctcgatactactaactatacttgatgaagacccattgagcaggcatagagtatagctgccagcaaagcagtctaagtcccatagctcctcggaatctgcagtgtctgagagaggtgactcatggcccagcatgtgatgttgcatctggagtcagaggtgtgttctagccaggcctgggagctctatgtattgcttagctgtcccagtaatggtgtctcttcatccaaaagggcacctgaggcagcccatgctgtgctgagattttggatctgtgcccagggcccagtgccgtggaggtctacctagaaaatagtctctgttccaccttcaccatgatagacacagtgagctctcggtgtgggttcagtgccctgtagttcaaagacaggagtctgggccaaaggtcggtgttacctcatccttgccaggggctgaggaagggtgagagatgggccactcctggagctactgcttcatcttctcatgaaggtgaatgaagctgccactgcaggtaggggctcagtaaggacagagctccagcccaggacctccacaccttgcacaatgcgattttatcgttgttatggactgaattgtctccccgcaaaattcctatattgaaatcctaacccccaatacctcagcatgtaaccgtatttggaaatcagacctttatttatttatttatttattttgagacacagtcttactgtgtcgcccaggctagcatgcagtggtgtgctcttggctcactgcaaccttcgcctcccatgttcaattgattctcctgcctcagcctccccagtagctgggattataggtgcctgccaccatggctggctaatttttatatttttagtagagacgggtttttgccatgttggccaggctggtcccaaacccctgacctcagttgatcaacccatctctgcctcccaaagtgctggtattgcctggcctggaaatcagacctttaaagaggtaattaaggttaagtgaggtcataaaggtctggcccccctcctatggtggcacagtgtccttacaataagaggaggaggagatgccacgtatgcacggtcacagagcaaagcccatgtgaaggcactgcagaaggtgagcactgctgatggcaggcactggagaaggcaggcactggagaaggcaggcactgcagaaggcgggcactggagaaggtgggcactgcagaaggcaggcactgcagaagctgggcactgcagaaggtgggcaccatgtgaaggcactgcagaaggcggccagctgcgagctgaggagaggagcagcaagagaaaccagccctgcaacacctccattttggacttccagcctctagaactgtgagaaaatgaatgtctgttgttgacactgcccagtgtggtattttattacggcggtcctagcacacaagtacacttggggtggggtcagacactcagttgacaggaaggtgatggtgaaagtttccgtcctccctggaaacaccccacccacatggtcctgaggtgtctggctttcagaaagtgactctccccagtgcttcatttgctccgtttgtttctaaatgtgtctgggtctgtttccagccttattttgtcttcctttaccaaccacctccttccaaataagaagattctcgcaggtccagtctcagagggcagaaaacccagatctctggagtttctgtcccgagaggacctggcacctgacttcctgactcaactgctggagggacgcggaggactgttgattggacttgctccttcgtcgtgtccccacaccgcgggtggcaggactagagccttgccgcattatgggcttctttattggctggcataaatttggccacttctggctgtatacctcttgcacagctgtgcttcttgttttgctcctgtggtcagtgtggtttctgagatgtctgaggaacaacctgaggaaagctgtggccctcctgaccatgacagcccagacctaatcactgggaccccccaatccactggcaaggaacagtcagtgagcgcttgaagtgtcatacactcccctgcccccaaggcagtggagcaggtgaggagtcactttgtcactcccagggcgatggcctcacctgtctcccgtggcctccggggctgtgtgggcgtgtgtgggtgtgtgtgtgcgcgcgtgtgtgtgttgctggtagtgaacatgccctctggtggcccccgcagacaggcttgctgtttcttccctagatgttagcctcgcctcttattttttattttttttttttttacctcttccgcgtctgcttaacctcagctcccagtaaacacgctagggacaacaggcttccctagggccccctatctttgctagtcctaagccctgaaagacctcgctttaattcttccagcatgagcctttgttgtagataattctagctatctgattcaaacatgagagtaatggtttttacatcggagtcaggtacaaacctctgttacacaaaggaaaccagaaatcgtatgattccctagggatgactgaaattattttgtttatcatattacttaaataagtacgaacataattttttatttttattttttgagaaggtgtcttgctttgtcgcccaggctggagtgcagtggcgcgatctcggctcaccgcaaactgcgcctcctgggttcacgccattctcctgcctcagcctccccagtagctgggattacaggcatgcaccccaatgcctggctaattgtttatatttttagtagagacggtgtttcaccgtattagccaggatggtctcgatttcctgacctcgtgatccgcccgccttggcctcccaaagtgctgggattacaggtgtgagccaccgcacccagccataaaattatttaacttctatatattttaatggctcttaagtaattctaaaaccaaaatcagtgtacaaagaaaacaccaaaagttcctgaaaaaccacccgaacttgttagcacattaatgtgacttgctatgttgtttttctgaactcaaacaccatgaatgctgcactcagtgatacccaggctgtgtggtctgatgatggggctcttccaaatcttgcctctattggaaaaattgcaacatttcactatacagaacactattgtggcgtttacaaatgaaatcctctgctccgtcctataaaattactactatttggctctgagatctctagacatacttagttgtgagagttgtgagatgatcatctgatgtcagatgtgtttacattaatttttaagactttaattcaaatgaaaactaaaagtcttgtagagaggacctactgaatgtgtctggtatgagtctcagggtgtttggaaactccagatctaaaattcttggatttgagaccctggtatttcacttaagaagctctttacctgcctctccctaggcctgggtttgactccagccactcccaatgccctgtggggctgaggtcccccagacaggcgctggggacctggcttgtttttgttttgcttctcctgggcaaggcaggtgcacactacatgctcagtgcgaactgaaacacaaagtgctgggtggccgctcagcggacggtactccctgctcccctgtggctcctcaactcagtctgtgaagggtccccatgcccccaggccagggctggccgaggggggctggcctgctacccaactgatcctggtggggggaccagctgctcaccatgcctccaccagaggaaaaaatagcagttcagtctttggaaaaaactagcgactcacacgaccagaatagcaactgaagacgctctaaaaaacagaaacacctgcttcagaattatggcaggaaatgagatttcagaaatgccacaagaagctggtgtcgcagctgcccctacctcgtattcccccagccttcgcccgccagctggggctgcccacagggaaagccccttggcccactgcctgtggtagccgctggatagggcctggcatgtggggtcagggcccagtgccgcctgcctggggctgtctagcagctgcccctgccatgctggctgcgggcgagactccacactcctgtgtctgagcctcttgagtggtaacagaaactcagggtggactagtcacggaggaaagggggatatgtggtctcctgcgagccccctggactgagccttccttaggcaaactgtgcagctgttggctgagcctctggattgatgaaatctcttgagggactccacagggctttcaagggaagtggaggggtgatgtgttcagtctggagcaggggtctccaaagtggagtacatacatcccagagggcttaaggaaagaaaaataatagtgcatctactcagattaacattttgcttccaacatgaaagaaaaagctgtgcaatgttagtaattttgaacgttgagggactcacgtgccttagacggctgtgtaggaggagtactttgtgggaggaagagcggggatttcatcaaattgcaacttacatagtgcccaccaaagggaatttagatattctattatctatttttaagtcaactaaggctcccaaaaaggataagtggctttaaaacaatgttgaaaagaaatcttggactgaagataacactaatatgaaatcataccacgcagcccccacatggcagagctgaccctccctcctctgcccccagccacgttatgaaatgaaaacagcagcactttcctcagaccttgaagagttggctgaaattgcaatcatccagaagactatttgaaatacggctttacatccataatcattctggttggatgttgtctgaagtgcgtattgtgccaagagagggtaataagacatttaaaatatttttaatttcacctttatctcatcctttttactcttcttttttggatgttaaaaaataatagcatgatagtgcaatgtcacacggaagtatgcagaagtaatttataaaattaaataatcagaatgtttgggtacatgaacaactttttgtcctgtggtcagggcaggcaatacaaaaactcagggacccctgatccagccaagtggatctcaggcccacccacaaagtttctgatccattgggcctggaatggaacagagaatttgcctttcttttttttttttttctttctttccagttaaccattatttccttcattttgttttcattatagcacgtttgcttattttacagcaagcagaaaataagctgggtcttgttttgatccaaacattgatgttttaaaagctgtacacaatatttcctaaaaagaatacataaaagtacctttttagaagcttctataagaaagaaaatacgaagtttaaccccacaattttcctctttgctacaagttcaaactattgctacagttttaaatagactttttgttgtttaaccagacatccaggacaatcttaaaaaattatagaaacgtgcacgtaaatgatgcatagcagaacttggacattaactgcaaatggtaaagaaatgaaagttagaaacactatcaaatatacaaaggttctagaatcaatcctttataaacacattccacaaacaatatttaaaagccatgtttttgttctttacaggcaaaacctagattactaaaaccaaaatggaaaaaagtaatcctttcaaaggaattgtttccctaagataattcgtacttaaatatgtaagcaagcatgtcagattttaaaagatgctagctttctattctgaaatgagattggacatgtcaagtcacttttgcccccaaaacaatctttcagagaaatgctttaaattataaatgatatattgaatgaagggtataataaatgaagcgtattactccatttttagtcaggcattacattgataaccaaaaactcagagatgtgacttgctgaaagttgactaattctttttccaaaattactttgaatttcatggaacaacagaatcatctagaatgaagtgctgtctttcatcttagctcacattaaataaactgaggcgtgaagagcaagcctccctcataaagaggtaggcaaatttgtctacaaacgcacacgccatgtactgcaagcatcaaaatttagtacttttattttttacttttttgagatgaagtctcactctgtcacccaggctggagtgcaatggcgtgatctcggctcactgcaacctccgccttccgagttcaagtgattcttctgcctcagtctcccaagtagctgggattacaggcatgtgccaccacgtctggctaattttcgtatttttagtagagacggggtttcaccatgttggccacgctggtcttgaactcctgacctcaggtgatccgccttccttggcctcccaaagtgctgggattacagctgtgagccactgcacccagcctaaaattcagtacttttacatatgcacgtgcaaaacctactttgaaacaatttacttgcttctaacagcagtatgaaaacaaagaaatactatggtcaccagtgctccttaaatcttagaataattgcatagggacattctgttccccttaaaattatttctgccatcactgacctgctcaaattttaaggtaagtttttctcatgttttctatgtccaaatcttcatagaaaccaaaagaactagtgaagactccacgtttcagtcaaaactcaatctccctgaaaatactgcataatccagctggcatcattccctaaaacagtggggttaacaaaagaactattccccattgcatgatagacaaatgattatcacaggcctagacatcttgtcaggacaaccaggcccagcctgaacctaaatgtgtctgagcagtagtgctttactgtggttacaacttcacttttgtatcattctatcttattagcaagctacatttctaagttaacagttctaccaaatatgaatatgaaagtttatttttaataagacaatgtgaggccgggcacagtggctcacacctgcaatcccaacactttggaaagccatagcaggtgatttgcttgagcccaggattttgagaccagcctggacaacatggcgagaccccatctctacaaaaaattttaaaatgagccaagaatggtggcgtgcacctgtagtcaaactacttgagatgttgtggtgggaggatcacttgagcccaagaattagaggttgcaatgacctttgattgcatcactgcactctagcctgggtgacaaagcaagacagcctgtttttttttaaaaaaaaatgttgcaaattatggtcaaccaacatctttttgccacaaacttcaaacacaaaaaaaagaatctttacaaaaatatacagggacaccacaaattggtggttacctataacattaaacaaactggactcttcttttttttttttgagatggagtctcactctgtctcccagtctggagtgcggtgctgcgatcttggctcactgcaagctccaccacccgggttcatgccattctcctgcctcagcctcccaagtagctgggactacaggcgcccgccaccacacctggttaatttttgtattttgtttagtagagacggggttacaaactgactcttaaaagtggcttctccacagcatatcatttgaattattaccattgcctggtacagtgtttttaaagtattgttacaacattgtattcctgatttttttttttttttgagacagggtctaactttgtcacccaggctggagtgcagtggtgtgatctcggttcactgtagcctcgatctccttggctcaagcaatactcctgtttcagccccaagtatctggtactacaggcgcacaccaccatgcccagctaatattttaatttttggtagagataggggtttcaccatgttgcccaagctggtcccaaactcccgggctcaagagatctgcccacctcagcctcccaaagtgctaggattatagggtgagccaccatgcctggccaattcctgataatttaagtaaaccaaactataaataaatgaatgatatgtgcctaaaaacaaccatagtttatattatcagtggccattggatttaggagcagtccaataccttgatgtagattttgatctagaactagactttgatcttgactgacatttggatataagtagttttttttctttgattccttttcatatcttgagccagacttatttaatatgctttggaatcttatttatttatttatttttacttactttttgagacagggtcttgctttgtcacccaggctggagtgtagtggcacaatcaaggctcactgcagccttgacctcccagtctcaagcaatcctcccacctcagcctcccaagtagctgggactacaggcatgcaccaccatgcctggctaattttttttttttttttttttttttttttgtagagatggcattttgccatattgcccaggctggtttcaaactcctgagctcaagtgatcttccagcctcagcctctcaaactgctgggattaaaggtgtgagtcactgcacccagcatggaatctgttttagaggtgcctctagttctggtgtgagatgcagacctagaatgtgatttagccttcacttcttccttgggctgccttgaatgagatgtagatcttgaaaaagatggattttggtgtttgaatccaccattgtcggaatggcttctgctactccgtggttttccagttggttgatttctaggactgtaagatcttctataattgtaatcaaaagactgacttctggatctcctttcataactttggcttctagaacttctgtatctgtcataaccatcatggcgtgaagagctgtacacattcctctgttccttggatttcatctgatttggtgtcttctgatccccctgtgtaaactgtatttcaacttgatgtccacaaatctatttcctgtccaaattatgcaaagcatcttcagcatcacaaacatcctcaaattgaacacaagcaaatcctcttggacggtgggtgtggaaatcaagtggaacataaacatttcctgtaggaccatcatgaccaaatttatcctgtctatctgcagacctggtgtcattggccacgttcctgatggacagagacatgttttggaggagtgtgcaggtagtgggacatgatggtggcgtgagtccaggccggaggccctaacagaccaggcaaactgtccatagctctgctgttagaaattcgtatttctaacaagttcctagatgatgatcatgctgatggtctgggtaccactagtctatagaaatgaccacagcctgaatgaagacaagctgaaggcagtgaggctacctctgcccttgtcaaccttgctcacaggtggagacaaggctgtcacctgaagactgatgatctctccccacagcctgccacatgcctgaaattcaccctcagtgccggactcctttggactccttagccttaaacttggctctgcaactgcctctagaaactagaagcagtgttagcgagcggcgagcagggatgcagagggcagggacggggaggaggaggggtttgtgatcccacctaccagcctcactgccgagggcacaggcttggaagcctcaggctctgatgtcagagagagctgagctggattccctatgcagccgctagctagcttttgacttcaaatctcaagaaaaagaccttattatttctaattctcttcctgccttctaagaagggtgggtcttggtagctgaaggctcttgtctgctgggctcagcacgggttgtgggcatgtaagcatggaggagctggtagcaggagctggggagtgggaggctgctgcgtaaaggaagaaggaggaagctgtggccagtgagaaagcacggaggagacctatgagaaggaagctgtgagctatggggggtgcagcccaccctgttcctctggccccacatgccaccatcatcctctatggggcacgtcccgggaggctgagtccacatcctggtgggtgtgaggaaggcctggtgcaggccacgtgcctggtagggcaaagttgtaaattagatatcaggaccttttctgtccccctctgccccaggactcctttcacctcacatagctatttttctttctttctttatatttttgagatagagtcttgctctgttgctcaggctggagtgcagtggtgcgatcttggctcactgcaacctccaccttctgggttcaaatgattcttctgcctcagcctcccgaatagcttggattacaggaatgtgccaccatgcctcactaatttttgtatttttagtagagatggggtttcaccacgttggccaggctggtcttgaactcctgacttcaagtgatccccctgccttggcctcccaaaatgctgggattacaggtgtgagccaccacacccggcctctttattttttaaatatgcatttttataagggattcctgaaaaccagaagcagtgacacaccaaggcatgtgactttatggcaggatttcctgcacagcacaggccaggagagagtcagtgtccttcagattgggccaagtcatatccatgcacatccaggccactcgcttctgcagaaaggcctgctgtgataccaggtttctggacctgcccgtgttggcactggaattccagcctccagcatgcatcctgcagggaaaagggagcaagctctatgcagctccacaaagttccagcgtagcctatctgtgcctggtgctactggttggggctggcatgggggagcctctgagctccctcctttttcagcacggctcatgcacccatttgcctttgatgtaattctagagcctcctttacctgcatgagttagtgcctataaaaggccggtgagaactgtgtggagacaacaggcctcagagggtccaatcctcaccccatccctggccacctgggtgaccttgagcaagttcctcaatgttacggagccccagtcccttgctctgtaaaatagggtgatgagggtgctgactgcagacagccatgaggatgaagtgaatgtgtgtgaagagcaaggcccagtggatgctccctgtgtccttacaataggcttacccaattggactaaattcttttttttttttttttgagacggagtctcactctgttgcccaggctggagtgcagtggcgcgatcttggctcactgcaagctccgcctcccgggttcacgccattctcctgcctcagcctcccgagtagctgggattacaggtgcccgccaccatgcccggctgatttttttgtatttttagtagagacggggtttcattttgttagccaggatggtctggatctcctgacctcgtgatccgcccgcctcggccttccaaagtgctgggattacaggcatgagccaccgcgcctggcccaattggactaaattctaaaaaaccctgtgggttatgccactgagctaaactcagggaatcttatggtgggatttctggggcacctgaaggttaattcattcatgtatccacgcaacaaatttatacagagtactgactgcatgtcatacaataagctagtaaatagctaagaacaaaagcttttctgggagggctattcacccagtagggccttgaggctctggcagagctccctggagactgagctgctgggcaggggagaatggggcaggcagtgggcactgccagtggatggaagcccttttccatcccaggcaaagtggcagaagaccatggaggaactgccaggctgaagggcccacagtgagacccgggggagtctgaggctgcagggagtggccagccacctttttgggccatgagtgctcagccagctcttcatccaggtgggagggtgggaggaggctgggctctacaggagctactctctgtacacctgccctcctggagtcatcccagtgcactgcaagctttggaagtcagggctttggagtcagacctaaatgcagaccctcctcctctgctccgcctcaggaaagtcactttaacttctgagccttagtttctccatgtgtaaaatggtgataattgcatcttcttatttactctgcccaggagaaccaaatgagatagtaagagcaagtgctttcaagatgatagcaccttatgcccagtgtctaccatgtggcagtctatagcaacaacctcctcctcgaatggtttttgtattttaaaacagaaacaaagtctcttgcatttaacagcaacatggaacaatgacctttcagcctctttatggcgaggcaaggatcctaacagacagatgggggagttggaggaaaggagctgaacattggagcagctgagctgcagcgtgtaggaacatctggcttacccttaggtggacagtgggtctgaatggctccagtgggtgccccaaatgcagtggctgcacagacggtccagtgggcagctgctgccttgtagatgggctcaaggtacagcttcaagacagcagtggccacactgcagatggtggtgacctgtctgcactccccacctcctgcttagggtgcttggtggcttcctgttcactcagttttctcacccagtcttttcaatagaacttttacccacaaagcacagccaatgaccaaggacaccttagagcaaggactagtaaaccacacagcctttgcaccaatgcgccccactgcctgtttgtgtacagcctatgaactaagaatgatttttccatttttaaacggttgaaaaaaactcagtagaatattttgtgatatgtggaaatcatatgacactcaaatgtcagtgtccataaataatgttttgttcacttgtatggtttatggctgcttttgtgctacaaaggcaggttgcatacttgcgacagactgtatggtctgcaaaacctaaaatattatctggtcctttgcagaaaaggttggctgatccctgagttaaagataccttccttctaggaggagttgcaatttaattcacattcatcccttaagcaaaacagatgaagctctaatggtggaatttcaggtgtgtatctgtgacaggttgacgtttctagggggaagtaggaggaaaattagagccaagtaacagaggcagcaggatgtaaaatagaaattttactaggcagtaggaatcctggtttctaattccactttcaactgatgaataattatgtgattttgagcaaaaaggcttttcatgtcccagccactttccttacccaggatctcctctcctgcccttaaaaaggaagacaatagctgtgaaatgctttgagacctaaaaaaaagtcattcaaatcaaagattaggaggaaaaaaaaattaggcaattctagaacattctgataaggtgatatctgatatttcttcccttttttgatatctgaaatatctgatatttcttcccttttttttttttaaattttttgagatagggtcttgctttgtcatccaggctgaagtgcagtgtcaccaacatagcttactccagcctctacctcccaggctcaagcgatcctcttgcctcagccctccaagtagctgagactacaggcatgtgccaccacgtctggctaatttttgtattttttgtagagttggggtttgccatgttgcccaggctggtctcaaacacctgggctcaagccatccgtctgcctcagcctcccaaactgttgggctcacaggtgtgggccaccacgcccggcctttcttcctttcaaagaagggaaacaaaatatctataggtgtagtgaccctatgctcctcaaaacccttagcttgacaacaagtctattataggcccttggcatttgtgcaactgagacacagtcattcccaagccacccagaaggtccccgacctatatatttgttattttgcctaggcacaaatctgagttactcagctgctactaagtgaacctagtgtatgtagtggatggcccagtaccgacatcccaggatggctggctgttctttcctggttatgacagacatagtaactaataaagtgacttaaaacatcctttgtaaataaacgctctgtattcatgacgctggccctctcaaatgtctaaggagggactctccatgagtgacgtgttttacgttaaaagtatttatttgcaatcagggactctggcctgtggtgaccatttctagaagctgtctaacatatctttaaataccgcgcccagaagtggcttcctttcatggcagtctcagtttctggttcctagaagttgctgattccaacagcacctgatgaccacaagtcatctgagggaagctgtggccaagaatggataacaaccacattttattcggacaccaaagcaagttgcaatctgaattgcaaccacaccttgcaatggcgccaacacatgca

SEQ ID NO: 134 - DNA, 8078 bp, Homo sapiens
  source 1..8078: mol_type = genomic DNA
gatagcaacacatccttcttcttctaagaaataacccaggaattccatgagttagaaacaatagtttttcaggtattcctaactaaataaagttataagagtaaaacaacaaaataacagacatgaacaatttttattttttacttatcatgttacattccatcagaaatgtttaacattccatgtattaacatattacactatataaataaaatatagacaataccttgtttggccaaaatttttcctctttagtgttttcttttttaaatttattctcccactgccctttgaaatagattgcgttcacaagaaccagtgtcgtatcattgccaatagtcccatcaggaaataggtttttaattttttctgcaagggaaagaataaaagagtcttttacacaagctacaaatggcttgtctggaagatgctttgcaaatgttcgtgactgatcgttaattattgacccaaatccctgcttgagactcactgactttgatctttgaattgttagactcactgaccagtggttcaccagatgcagctttcttcaaggctccagtcgtataaagttacccttgatggagacatcacttcttgtgatagagaaggagttcacgttctctgtgtatgaatgtctccaatcatctgatttggaatactgataaactgattttgtctactcttccaacatgtgtctttcctttctccctccctcctcttcctacttttatttttttttaactacggggtccccattcagaggaaggaggccctgattgcattttaggatgagtgacttgagctctgtaatatgaaacgcatgtcctgtgctgtcagacactacttccgggggtatcttcctattcactctcatgttgagttgctgtaagtttggcctgtaatgagaggtgggaggtaagaaagatgtctgtagaatggagactttgtcaagctctttgcccttgatggggaagagagctgtgataatccctgcagaacacattggctacagatgtgatccaggcagctccagctcagagacaaaagggtgatttaccagagagctgcttgtttcccaattagtaaaggagacgagagacgctttctaatgttttctattaaatattcatcataaaaatttgagtctgatttaaagtaaaggatatgatctcaaaataggcctgagcggagacaggggatccacaaagctattgtcatgcagggccataagcaaataattctccagatgtgtttccatctaattggcttcctgtgatttcctccttggctcccctaggctctcttcatattcatttggacaaatccttcatctggagtgccctcttcagccctccctgcaaacccatctcaatccccacacctgttcccccatgcagtgtcaagcacaaggctcactggcataggtttctcaaaggtgtttctataatgggtggctctcctaccattcgtttgactttccacccaggagttaatcttctttcgactttcttctggagcatttgcaaaatcagtagattccacactggtctggtaaaatttcttgatggcatctaaatattcctttgagatatgaaggaagaagtaggaattaggagtaatttatgtaactatatattaccaaacttacttatttgtaacaacagtaagctgaatccagaccctgaatagatgcagtatctcctgtccatggatatttttatacaggtgtcatgtaggcaatgcaaaaggggaatgtgggctggcacaagaaagaggtcactgaaggtcaatatcatcttggcaaaaggcagaagcagaagaggctgtggtttgcaaactgcagagcaggcttccctgaaggagattcattgcttctcagacttctctccagtaattttaaccatgatgtttctgatctttgtttttgtctttcatcctgtgcattcaatatttcctggtacttcctcaactattctcaggaactcacccaagcctgcccattccaataatatcccattagtcatacatttcccaccaagatgtatcgtatgtgactgagtcagtgccagtttatcgatggtatcttattacttattactcttactcactctattacacaacctcctcttttatcacaagattatccctaaatccacacttcagtgatgtatcgttggggtctgggacactccagtgggggagagttgtggaaatggagctaatgcactctgagtaaatgctctccacctgagtcggccaggctcatctgccttgctttcttccatttggccactcagagacacagacatcaggatgcaaatgaaatgtgggtaggccaggtgaaattacctgtaaaaattgatacgtcttttctccgaagagcttgttggcgatcttcagctcatatgcatcagtggatttgttgaattcagtcagaagcttttgaaactggtgatgaacatttcctgacctatcaaccttcaaacatcaaaaagggagatcattcaattgctgtatcaatgtaaatactaaacccatgctaagtctgttagatcagtccctaaatgctggtagtctcattgaggacctttgatgttattccctgataattggtgtatttcacctcaaatacccttcaaaatccaccttatatttgacttcttccagaaaattcttcttgctctaacgtactgcaatcttttctcttctgaactaaagatgcagcgctgtctaccagtagattttctccttgttggtttaaagggttaggtttagcttcccagttaaactctcagctccttatgggcaaggaccatatttcacttctaacagtcatcaaggatacgagtatgttgaaggttggatattttaaatagattatgccaggaagccctgttatacctgttggtgctattatcttgtaggacacattgactgatctgtggctctttcctcatgatggtcattctctgcacgtaagaagagtgtatgccaggtccatggctaaggactttacatgggtaactctaagtctttagttcaattcagatgaacacaagaaagctcagagaatggggaaaaaaaccctgtttatagagacataaattagaagtgccaagttttgaacctaagcctgtttaaatctagaactttctaccttccagcaaagcattttgcactattaaggctctaaaccaatatattccatagcaatcattttccaaaatatacttggacttgtgcttattcctctgaatctcattaatgactcaatgaaaattaaattattttcacattattatgattagtataattatagctactttataataataataacatttattatgacttttatgggcaaggcactgttgtaaacatttgcatgtatttgcatgtattgagtcagattttttcttacccttagttttctgggatgaggtcactgggactccgagcagttgtgtcctgctcttattcatcatttgtgaagagcaaagctggagtctgaacccagcctatcctgatccagacctatgctctgaggtacagtgctgactgtcttttagtaacgcagaaatgaggaataataattatgtgccatgaaatgccaacccactctgtatgtctcaatctttgtgtccaagattttccctaaaactggccttttcttagtttttgtgaagttccaggtttaaactatgacctgttcagggatctaaagctgaaccatagtgctctgtgactcacatgatatgttgcagctttttctgtggtgttctctgtgacttgatcaaagtgaagaacctggaagagacatgaagcgggacaagaaaactttactcaaaagatctgtttaagtcagtggtctcacagttatgggaattcctgcacagccccctgtgctacccatcagaccaccacatctattaccatctgcgtgctagccgacggaaccagagaaaaactgcaacaggacaacgtaatgatgctgatagctaccttgctaatttgttgtgcagtgttgtctttggctcctaagaggaccatccctaatgctgatgtgatgctgataggggaatagaagatgttgttctcttttgattttctgaactgttggaacagatcgaacatgaacttggtgttggcttcactgagtgaattcatggtgaactcgatgtgatctggaactcctggaaaagcatcagattcctgtcagaatgactttaataaatggaatggtattttgtagtacaattttcttaaagaaatgatatatctgggttgtgagattttgacatttaaagtttttctcttatttttaacgcttcaatctttctacaatgtgcatatattaaatatattaatgtcctaattagaaggcttacaaaactacgtttttaaagactattgtaaataagtaatcgaccctctttatctttctttcattgctggttacactagagctaggtaggatggctttacaatgaatgctaacaggagacctctgtggatcacatccaaccagctgttaagatgcgtccctgacatctccttcaagactctctggctgcaaggcactctccctctgtgttcctaaaagtgccttggtttacttggaactaagcaatttagataaaggacaaatcagatgaaataggtattttaattttgctctggcagaataagtaaaatataatcagacagaatgcaggagatgcatgatatagaacacagtatcattattattctcaaaaataattcatgttattaagctggagaggcttgaagctcttacctgtgttcctagaggaagcagaggtgggcagagaggctgtgtgtgtctgtggaatgaagggtgagatcctaaatttatgcctctcctcttgctgcctttccctctgtggttagtatttgaagttactcaacttcagatttcacaagcgggctaacactcacctttatgaatatgaaaatttatgacaaaggacaggattacagttctaccattgtacctcctttttaatctatagggaaaaaataagaatgcaagtcagcagtcaccggctcatgtgaaatacatgtaggtgcctttctaatgccaatgagaataagtttagaattccaatttcctctcatttgtttcaactccatccctttgtattctactccagctgtaaaacaaaaacaaaaacaaacaaacaaaaaccccaccattcttttcttggattttgcattgtcttttaggcatacttcgaataccaaagaactaaaaagcttacatttcctgtttttcagttctgaaagtttttgtcatcctatgaatttccttagtaatttttctgtataacaaggaatgtagtgctaattctaagtccaaagagatagtgaagaagtgtacttcagtatcttatagcatactatggagaataggattctattgccttctcctgagtgctcagctttggcagtgatcctaccagtcacttcctgtgccccttacaaccatcccagatggttttctgttgcataggctcagtgagaaagttatctgccttgctgagtgatatggtttggctgtgttcccacccaaatctcaacttgaattgtatctaccagaatttccacatgttattggagggacccaggtagaggtaattgaatcatgggggccggtctttcttgtgctattctcatgatagttaataagcctcaggagatccgatgggtttatcaggggtttcttcttttgcttcttcctcatcttctcttgcagccaccatgtaagaataacttttgcctcctactgtgattctgaggcctccccaatcacgtggaactctaagcccaattaaacctctttttcttgccagtctcaggtatgtttttatcagcagcatgaaaacagactaacacattgagttaacaggctgacactgagaagagcaattgaaacagacgggccattttaaatggcagctttctaattttacatttaaaaatgaagccgaaaaataaattgcttgacctgtcaggatcacaacatttctcaatggtccttctgtttagcacctggcttcagactcattccagtgtttcccctggaatatcttgtaatctgaagaatgtctgtggccagggagaggggttgttgtccaaggccatttaatccaatatctccctgacaaccagagtggggggctgtttgttttgtggaccccctttttattaacatataatttatataccataaattcaactgtacaattcaatgattttattatattcacaaagttgtgctatcatcatcatgatctcattccacaacaatttcactacctccaaaagaaatcttgtacttcattcttcccttcctggagaccctggaaaccaggaatctacctcctgtttctatggatttgcctattccaaacatttcaggtaaatggaatcatacagtaagtccttttgtgactggcttctttaatctagtgttattttcatggtttgtccacatcattgcatggatcagtacatcattcctttttgtggtcgaataatattccattctatgaatagaccagattttctttaatcataagttgatggacatttgtgttgtttccatccttttactattatgaataatgatgttgtgacctttcatgtacatttttttgcatggcatatttcttcatttcttttgagtataaacctatgaatgaaatcgctgggtcatatggtaaatccaggttaacattttgaggaaatgccagactcttctccatagaattctgcacaagtgtgcattccaaccgaccgtgaatagagttctgatttctccacattctccccaacacttggtattgtcatgggccctttttaacaccagccgtgagtttgttttctcagcacatcacaaagtcaagggagatttatctacaacaaggtgccagaaacacataggctgaaagtaggggctggatgggagaaaggaagctgtgtttccaatctggaaatttctcacctgcctgtttcctcaacccccaagacatgctcttcttaggtctcctgtatcaatatatatgttttgagtctctgaatgagtttaagaggtataagttccctgattgaagtcggggaatagactaatggggcgttgatggactaaaaatccaaagatagaagaaaaagaaagaagaggaaatatctgagataaagaattccaaaaatgaataatggtcttctcagctgagtctgcatccagcgctataagacaaaaatggaccttcctctattggagtaggatggatttactcgggtaccaaagaaaaggaatctaatgtctcataggacagaagcaacaagctcatcctgggaatggagggaagaaaaaaacaggataacaagctgagacaaaccggggttacaggggaccaatctatggaagagaatttcagactatggctaaacgtcctgaggcacggaggtttgccctgaaggttgaacttaaggaaaggtactaactgaaaatgaccaggagtttgcttaaatttagagaaagcttggatgagttcaaatgagaaatcatttcaggcatttttttctgttcctaaatagttctcctagcatgtgatagacaggctagaaaggacatatcctggtgtgtgagactggacatatcctgatgtcatatattgccacagagaactcagaaattccaagaagtttttgcatatgaacacttgccaacttatgtctcttgatatttcataaacatacaccaacttcattggctccaggaatccagaaattaaaaacaaatcctcaatgggaaattacactttcaggaaatatcctgtcattactaatgcctttatagattggttaagaaatatctcctagattttcctggacctcacttccttatgaaggctgtaaagttttctcagcattgttaagtaacaaagtcaagagaacattttatttattgtttcttattatgtgcttgtggcaatctatagggaaactggttagtggaggagatttttcaagcatcaaataacagaatatat

SEQ ID NO: 135 - DNA, 20390 bp, Homo sapiens
  source 1..20390: mol_type = genomic DNA
actgagtaatagtcacaaagataaagcgagagagattgtggttagattccagaaggacttccgtggtggctccacatgcgccatgagtgcctattacgagtccgcggtgaaccagagagacccagccctgcccttcctgggctcctggcccggcatggagaacagtaaaagagaaaatgaataatgcatgagataattttaaattgagaggaggacggtgaagaaattagaagaggcagccagtgggccgggaaggtgacgttgcggcctgagccatctcaagggacctaaagtcttggtgggggcagagggcatggcccgtgcaaaggccccgaggcaggactgggctggtgcgttagaggaatggccaggaggcccatgtggctggagcagagtgaggagggagagagagggagaaggggagggtagggaggggatgggcaggttgtgcagggcactgtggcctccggggtggatgtggtgtttgggaccagaaaccctagggagccatggagggttgtgggcagagagggcctcccccatccactgagtggttccctgtgcccatccgtgagtgccacccgccacctccccctctgtgtgcccggcgctggtggggggcctcgagatgcttcgtctccccagccccctggcccgcgcccgcccggccgccgcccactctgcccacatctgaggcgcctaggagccggacagtctgccgcaaaccacggaatgtttcccggagcgccgggccgggaatgtcggcggtgaggaggggaagggtggggagacccagagagatgggccggggcggtgggcaccgccacgcgagggacgcagaatcattgtcaccctcaaccccagagaggggccaccacgatgccgccgctttacagatggggaaactgaggcacggagtggcgaagcgactttctatgtccacagggcttgggagaggcagcgctgggattcgaacccagacttcctggccacagacctcaggggcttgcccactaacccacagcaaagaggtcagcgggaactcagtgaatgaataaatgaatgaatgaatgggttttgtaagtgagtgaatgaaggctcattcactccgcccagccaggcctcccaccccagccacagaccaagcagaacatgctgaaacacaccagcccccatcctccagttcccaccactcccactaccatctggaagtccctccttgtatccgacctaggtctttcctcactcttttcttctccagggcagataaatggcaaggcgttcacaccctcccctgcaagccgctgagtctgtccctccaggagaagggcagagcccagccactgctcaccctggaagtcactggggaagggacagttgaggctcagagaggggcagtactttccccaaggtcacacagcaaattcttgtaacgtcagagccctgaacgattcctgagatgacgcccaattagagtcatggccggctgagcctcccatgttgtatctccttcaatcctcccaacaagtcgatagggaaggaaccattattatcaccattttatagatggggaaactgaggcttggcaaggggcagccgctgcaggaggtggccgggaagcgaccagggtaatgtggccactctctggatcagctgagcagagggaccaacttgttactctgccacctgtgatgggggtgatatgaagccatggctgccaggggtcatatcacccaggtgtcgtgtgtctaccccagccacacgctaagtcctcatagctgcctggccacgtggtttcgcccacctttgcagctggtggctttgcaaggttccatgaaacccctagcagggcggaggcaccttgtcctttgatagaaacccactgggcagggagaagccactggctaggggctccctggagatggtgacatttgagccaggcccagagggatgctaaagctttcaacacaagaaggtagcagggagggcattcctggcagaaggaactgctcagacaaaggtgtggtggtgcgaatgtgcccccgtgtgacagagctaaaatggggcctgaggcgggggcaggtaagagagacatgtaaagccaggctgtgatgggtgggtctcaaatgcgaggctgcggaggtggggctttctctccagggtaatggggagccatgggaggtgtctgagcgaacaggaccagagggacagatgggagagaggatctaaggggagagtgagcagatgttgggatggacagactatggggagccaggaggagggagaagatggggctgatgccagagatccctacctcagggatggggagtgatggtggaattgtccctgacatggggacatggaaggaggagggggtttgaggaagacgctgagtctggagaccttgaggaaagtcctggaagaagctgaataagggagagagatcgctggagtctaagataatgactagaacatctgtgatcagtaactgcttgtgaattggatggagggagggagggaggagtcgataggtgggtgggttgatgggtggacagatggatgagtggatggctagatgaggggatagatgggtgggcaggtgggtgggtggatggatagatgagtagagtgatggatggatggatggatggatggatgggagggaggtggatggatggatggattgataagtggttggatggttggatggatggatgagtggatggatggatgagtggatgagtggatggatgagtggagagatgaatcaatggctggatggatggacggatggatggatgaatgggcaaacggatgggtaggtggatggttgcatggatgaatggatggatgaatgcatggatggatgggtgggtggatggatggatggatggatggatggatggatgggtggatgaatggaaggatggttgagtgtatggctgagtgagtgaatggatgagtggagagatgaatggatgggctgatggatggatgcaggcatgggtggatggacagacgaatgggcaaatggatgggtacatggatgcatggatgaacgaatgcatggatggatgggtggatggatggatgagtagagggatggatgggtggatgggtgaatggatgggaaggtggatggatagatggataaagggatgaagggagtggtggatagatggatggatggatggatggatgaatagagggaaggatgggtgaatggatgggaaggtggatggatagatggacaaagggatgaagggagtggtggacagatggatggatggatggatagagggatggatgggtggatgggtgaatggatgggaaggtggatagatagatggataaagggctgaagggagtggttgatagatggatggatggttggttggctgcatgtgtgggtggatcaatgggtaggtggagcctgaagacagaagtggctgccctgagtgtgaaggcaaaggcacagccctgggaagcccccacatcagggccaggaagaggagatttggggaggaagcaggaactgtgccagttgcccctgtaactgcctctctgtgaggcctccccacccaagtcctttcctctacccctcttccccagaaatggctttgggacttgaaatccccgccccccgccccacaccccaccacacacacacacatggctcagctctggggggcctaccgcagacaaatcagtggaaaattaaaatagtgcctgtgcactggtgatcggcggcttcagccgggcacttaatgatccctttctggggattgttaccagctggaggtggcgggggggtggggggtcttcaccagccacccaatctgagcagtagggggtggtccctgggagagggggtgcagcccacaaagccagaagttggcagtgatggcaaagctgggaagggcttaggcagggaaagggatgaccttgagctccggggatgaacccacttggacccctgcacccctgtggcccctgctgggacgtcctttctctctcagtttggctagatggctccagctcatcttgtagttctcaggtccaatgtcaccacctccaggaagccctcctggactaggtcaaatcccctcagaagtatctaaccatccttatctataatcctatttgcctggaggccttgagagcaaaacctcactttgccacattagctgtgtgtccttggggaagtcactttccccctctgtggcttgttttcctcatttgtaaaataaggctgttaggagaattttttttcttttttagagacaggatgtgactctgtcatccaggctggagtgcggtggcacgatcacagttcactgcagcctcaaattccctgggttcaagcgatcctcccacctcagcctcccaagtagctgagactacaagtgtatgccaccatgcttggctaattttttagtagagatgggaggtctcagtatgttgcccaggctggtctcgaactcctgacctcaagtgatcctcccgcctcggcctcccaaagggcggaattacaggcatgagccatctcgctgggcccctgttgggaggattaaatgaacaattgtgggtaaactggtatttactgagcctttattatgtactgggcacagggttgaatctggtcctcaaattctcaaaataagccaatcaatgccagcaagatgttcatccccattttagggagagagtcactgaggcccctaggaatgagataaattcacttaataccgtcactgtgtgcccggaccagttcagttccctctgctctcacccctcacagtctgtcctccccacagcagccaccagagggcgcctgtgagcacctggatcaggtcctgtccctcctctacctacaaccctccatggctcctacctccctcagggtcaaagcccaagtcctccccatggtccacatgacctgccccatcctctccctgccctcccttcttccctctcttcccactaactctctctgctgcagccacacgggcctccttgctgttcctccaacatgccaggcgtggtcctgccccagggcctttgcacaggctgtgccttctgctcaagatgcccttccacctccccttagacaaactggctgtgcctcctccatctggcctcaactcaaatggcatccagaacacccctcccccaactaaaggaggtcctcctgctgtagtgtctgacccagccccattcttgtgaatgtaacagacacacacacacacacacacacacacacacacacacacacacacacacacactgcagtcatgctgtatgtgacttggcaggcgtctctgttcctcactcaactgcagggagggagatacttctgtcctagccttctcagggcctctagcaccccacatcagagagcatggctcataattggcactgaaggaccaggcgcagtagctcacacctgtagtcccagcagtttgggaggccgaggcaggtggatcacctgaggtcaggagtttgagagcagcctgaccaacatggtgaaaccccatctctactaaaaatacaaaaattagcttaaaaatacaaaaattagctgggtgtggtggcaggcaagtgtaatcccatctacttggggggctgaagcaggagaatcacttgaacctgggaggtgaaagttgtagtgagccgagatcgtgctgctgcactctagcctgggtgacaagagtgagactcccatctaaaaaaaaaaaatctctatcagtatggatttgtacagattaatgttatactttggtttctaatccaattatgtgtacacacacacacattatatatatatcctcaacaacagcaaacattatagaaatatttgcaatgtacttgcaaaagaattttactgggcaacaaatatgtaaagagttcctacaaatcaataagaaaagatcaactgaaaaaatatgcaaaggatatgaacacatcaccacagaaaatacctaaaagtaataaaaatggactttaaatctgtgagaaaatggctgggcacagtgcctcacacctgtaatcccaggactttgggtggccgagttgggaggattccttgagctcaggagtttgagaccagcctgggaaacatggtgaaaccctgtctccacaaaaaatacagagattagccaggtatagtggctcatgactgtagtcccagctgctcaggaggctgacgcaggagaatcacttaaacccgggaggcggaggttacagtaagtcgagatcacgctattacactccagtgttgggcaacagagagagaccctgtctcaaaaataaataataaaaaatagataaataaattaattaaaatatatgagaaaatgttcaccctgattcataggaaggtagattcaagttaaaactacaataaggctaggtgtagtggctcacaccgataatcccaacactttggaagactgacacaggaagactgcttgaggcgaggagctcaagaccagccggggcaacatagggagatcgtggctctataaatatggggtgcggttgctcatgcctgtaatctcagcattttgggaggccgaggtgggtggatcacctgaggtcaggagttcgagaccagcctggtcaacatggtgaaaccctgtctctactaaagatacaaaaattagctgggcatagtggtgggcacctgtaatcccaactactcgggaggctgaggcaggagaatcacttgaacctgggaggcagaagttgcagtgagccacgattatgccattgaactccagcctgggcaacaagagtgacactctgtctcaaaataaaataaataaataaatatatatatgtatatgtatatgtgtgtgtgtgtgtgtgtgtgtgtgtgtgtgtgtgtgtatattaagactgagtgctgtggctcacacctgtaatcccagcactttgggaggccaaggtgggcggatcacctgaggccaggaatttgagaccggcctggccaacatggcgaaatcccatctccactaaaaacacaaaaattatctgggtgtggtggcaggcgactgtaatcccagctactcgggaggctgaggcaggagaatcgctagaacctgggaggtggaggttgcagtgagccgggatggcaccactgcactccacccagcctgggcagagccaggctccatcaaaaaaaaagaaaaaagaatattcagtgccacctagtttgtggcgggaaaagactggaaataaacagaataagcattgagaggcacttttctttttttttgtaagcgatgcatccgtgcaataaatcgctgcagcattattagccattctgatgggcagccctctgaaatttaagtgatgaacggccgcgatgcttgtggttgtcactagagggaagcacatgaccatgaaagcttcttctatgaccgtctcaaattattgaagggtttatcctgtgattttcattcttcggttcctttcttttcccttttatttaccccatgcatttctatccgttttcttctttttctttttctctttctttcttttccttccttctttcttttttctttctctctctctctttctttctttctttttaaatttttttattttttgagacggagtctcactctgtctcccaggctggagtgcaatggtgcaatcttggctcattgcaacccccacctcctgggttcaaacgattctcctgcctcagcctctggagtaggtgggattacaggtgcctgccaccacgcccggctaattttttttgtttgtttttgtttttttttttagacggagtctccctctgtcgcccaggctggagtgcagtggcacgatctcggctcactgcaagctccgcctcctgggttcacgccattctcctgcctcagcctcccgagtagctgggaccacaggcgcccgccaccacgcccagctaattttttgtatatttagtagagacggggtttcaccgtgttagccaggatggtctcgatctcctgacctcgtgatccgcatgcctcggcctcccaaagtgctgggattacaggtgtgagccaccgcgcccggcctagatacaggattttgccatgttgtccaggctggtctcaaactcctgacctcaagtgatcccccagcctcagcctcccaaagtgctggcattacaggtatgagctaccgtgcccatattaactgttttttgttttttgttttttgtttttaagatggagtctggctctgtcacccaggctggagtatggtggtgcaatctcggctcactgaaacttccgtctcccaggttcaagcaattcttgtgcctcagcctcccaagtagctgggactacatgcgcacaccaccatgcctggctaatttttatattttttagtacagatggggtttcaccatgtttcccaggctgttctcgaactcctgacctcaagtgatccacccgccttggcttcccaaagtgctgggattacaggtgtgagccaccacacccggccctgtattaacttttgatagatattcaacctacaaataggaaagtatatctagtataaaggtacagctcaaaaattgtcccaaaccaaacacatttatgatttgtgtaatcaggtccctgaactcatcaagaaaaataatatttctgcttcccccaccacccacaaagtcaccctgatcctcccccttggtctctaactttcccatggttaagcactggcccgatttctgtcttcataaattagtacagggcacagtggctgacatctgtaaccccagcactttcggaggctgaagcagaaggatcacttgaggccaggagttaaagatccgcctgggcaacacagtgagacccaaaacgtgaacatatgtttatctcaaacataaataacaaagtaaattaatcaatcagtactgcccactgtgaactacattacactaaatcccataatgacaggctttttgtcctcaacgtaaagcttgtaagattcatctgtgttgttaaatgtttttgtaggttgaatatcagcaaattttttcttgtaaaaggccgtatcgtaaatattttaggctttgtggaccaggcagtccccattgcagctactcacctctgtccctgtagtcaataggcagccacagacaatatgtaagtgagtgggtgtgggtgtgtataccaataaaactttatttataaaaataagtgatgggctgtgtgttagtcagggttctcaaacagaaccaatggggagtgtttgtgtgtgtgagagacagagagacagagagagagtgattttaaggaattgtggagtgcagtggctcacgcctataatcccagcactttgggaggctggggcaggaggatctcttgagcccaagagtttgagaccaccctgggcagcatggtatcctcatctctaaaaacaaacaaacaaacaaattaataaataaataaaatacatttgccaggtgtggtggtacacacctgtagtcccagctagttgggaagctgaggcagagttgaacccaggaactcaaggctgcagtgagctgtgatcacaccactgcactcaagcctgggtgacagcacaagatcccgtctaaaaaaaaaaaaagaaagaaaagaaaagaaaaagaaaaaaaattgatttgcttgatatgggggctagccagtctaaaatttatagaacagggcagcaggctagacattcaggtaagagtcaatgttgcaggccgggcgcggtggcccacgcctgtaatcccagcactttgggaggccaaggcgggcagatcacgaggtcaggagttcaagaccagcctggtcaacatggcgaaaccctgtctctactaaaaatacaaaaattaaccgggcagccaaggcacaagaattgtttgaaacccaggaggcagaggttgcagtgagccgagattgcaccactgaactccaccttgggcaacagaatgagtccccgtctccaaaaaaaaaagaaaaccaaaaacaaaaacaaaaaaaaaaacagaaatagagtcagtgttgcagtgttgggtccaaaaactgtagggcagtccccacagtctggaaacgaggactttttttttttctttttttttttttatggagtctcgctgtgttacccagcctggagtgcagtggcgcgatctctgctcactgcaagctccacctcccgggttcaagcgattctccagcttagcctcccgagtagctgggactacaggcacacgccgccacgcccggctaatttttttgtatttcaggaaagacggggtttcactgtgttgcccaggctggtctcgaactcctgagctcaggcaatcatctgcctcggcttcccaaagtgctgggattacaggcatgagccaccgtgcctgaagaaatgaggatttttatgtcccagtcttgaggcagaattccttcttctctgggaaaacccgaattttgctcttacatccttcaactgattggacgaggcccactcacattacagagggtcgtttccttcacttaaaggcagctgactctagacattcagcacatctgcagaataccttcagagcaaaacatgcagatgcctgttggagcaaacaaccgggcagcatggtctcgccccatggccccatgcaatcaaacatcacagtctggatttgatccggggccatggtttgacagctccagtgttgttcacgtgttcctgggcttaggatgggaccatgtcctgataaactcttcataagttaaaaatatcataagtcggccgggtgcggtggctcatgcctgtaatctcagcactctgggaggcttagacgggtggatcacctgagctcaggagttcgagaccatcccaatcaacatggtgaaaccctgcctctactaaaatacaaaaaattagccgggcgtggtggtgtgtgcctatagtcccagctactcaggaggctgaagtgggagaatcacttgaacctgggaggcagaggttacagtgagccgagattgtgccactgcactccagcccaggtgacagagcgagactccatctcaaaaaaataaaatcataactcaaaaatgcatttaagctgggtgcagtggctcatacctatattcccagcattttgggaagctgaggtgggaggatcacttgaggccaggagttcaagagcaacctgaataacatcataaaaccccatcttggccgggcacagtggctcatgtctgtaattgcagcactttgggaggccaaggcaggtgaatcacctgaggtcaggagtttgagaccagcctggccaacatgatgaaaccccgactctactaaaaatacaaaaattagccaggtgtggtggtgcacacctgttatcctggctactcaggaggctgaagcaggagaatcacttgaaccccagaggcagaagctgcagtgagccaggatcaccctgctgcactccagcctgggcaactgagtgagactctatctttaaaaaaaagaaaaagaaaaaaacgtatgttggaatcatctgtcttcgtttcctgggccttccttaacaaagtagcacagcttgagtggctcaaacaacagaaatgtatttcctgacggttctgggggctggaagttcaaattcaaggtgttggcagggttgattcctcctgagggctggcagggagagtctgtcccacccttctctgtccttgacctgtaagatgacgccttcatgtacacgtgacggtgtccctaagtgcatgtctgtgtccaaattttccccctttttataaggacaccaatcagtttggattaggatctggactaatggcctcattttttttcttttttttttagacggggtctcgctctgtcacccaggctggagtgcagtggcgtgatctcggctcactacaagctctgcctcccgggttcacaccattctcctgcctcagcctcccgagtagctgggactacaggcgcccgcctccatgcccggctaattttttgtatttttagtagagacggggtttcaccgtgttagccaggatggtctcgatctcctgacctcgtgatccacccgcctcggccgcccaaagtgctgggattacaggcgtgagccatcgtgcctggcctctaatggcctcattttattttgattacctctgtaaagaccctgcatcctaataaagtcaccttctgaggtcctggggttagaacttcaacatatgaatttggggggcagcacaattcaatgcataatcaccctgttgtccatgtaggttttcttttttttcattcctgtttccacccattctagtgtggatgttcatttcaattagttccagttctgggctcttacaaataaaaccgatatgaacatttccatgcatgtctttcagtatatacatgtgcccttccttccttccttccctccttccttctttccttcccgtccttccttctttccttctttccttccttgcttcctaccttctttccttccttccttccctccttctttccttccttgcttccttcctcctttccttccttccttctttccttccttccttccctccttccttccttccttttttccttccttgcttccttcctcctttccttccttccttctttccttccttccttccctccttccttcccttccttccctccttccttcctttccttccttccctccctccttccttccctccttccttcctttccttccttccttccctccttccttccttccctccttccttccttccctccgtccctccttccttccttccctccttccttccttccctccctccttccttccctccttccttccctccttccttccctccttccttccttccctccatccttccttccctacttccttcctttccttccttccttccctccttccttccttccctccgtccctccttccttccttccctccttccttccttccctccttccttcccttccttccctccttccttccttccctccgtccctccttccttccttccctccttccttccttccctccttccttcccttccttcccttccttccttcctttcttctttccttcctttccttccttccttctttcgttccttccttcttttcttccttcctttccttccttccttccttccttccatctgtcctttcttcctcccttcctcccttcttccctccctccctccctccttccttccttctttccttccttttttctttttaatcagatggagtcttggtctgtctccaccctggagtgcaatggcacaatctcagctcgctgcaacctccgcctcccggatttaagccattctcctgcctcaacctcccaagtagctgggactacaggcacatgcccagctaatttttgtatttttaatagagatggtgtttcaccttgttggccaggctggtctggaacgctggacctcaagtgatcctcccaccttggcctgccaaagtgctgggattacaggtgtgaaccatcatgccagctggcttgctttcttttctttctctttctctttctttcttttttctttttctttctttctctttttttctctccttctctccctttcttccctccctctctccttccttccttcctcccttccttccttctctctctctgtctctttcttctttttgaaatagggtcttgctctgttgtccagactggggtacagtggcatgaccatggttcattgtagcctcaaaccctggggttcaagtgatcctccctcctcagcctcccctcagccttccaagtagctgagaccacaggcatgtgccaccatgcccagctaattttttttcttttttttgtagagtcggggtctcactcgttatgttgcccgggctgctctgggacccctgggctcaaggagtacccctcattgggctcagcctccgaaagtgctaggattataggcgtgagccactgtacccagccaaatgtccccttttcattaggacactggtttttggaccagggtcccaccctactcggggatgatgtcatcttaactaactccttctgcaaagacattacttccaaataaggtcaccttctgaggtcctgggtgttaggacttcaccatatgaatttagggaggcgcagtccaactcataaccaccctgttgtcaatgtagggggttctttttctttttctttctttttttttttgtttttgagatggattctcgctctgtcgcccaggctggagggcagtggcgtgatctcagctcactgcaacctctgcccacccggttcaagcaattctcctgcctcagcctcctgagtagctgggattacaggcgcccaccaccacgcccggctaatttttgtatttttagtagagatggggtttcatcatgttggccaggctggtctcaaactcctgaccttgtgatccgcccacctcggcctcccaaagtgctggtattacgggcgtgaacccagccggggggttatttttcattgcatccattctcgtgtggatcttcattaggttggttccaatctggggcttttatgagtaaagtgactatgaacattcccatgcatatcttttgctatatagatgtacccttccttcttttttttttttttttttttttttttttgagacagggtccgatctgtcacccaggctggagtgcagtggctcaatcacagctcactgcagcctcaaccccccaggctcaagcaatcctcccaccccagcctccagcctcctgagtagctgggactacagacacttgccatgcgtggccaattttttctcttctcttctttctcttctcttctcttctttctcctctcttctattctttctcttttcttttctttttttagacatggggtctccctatgttgccccggctggtctcgaactcctgggctcaagtgatcctccagctttggcctcccaaagtgctggggttacaggcgtgagctactgcacccagctcaagcattgttaatagggatacatataacataggtgaagttcctgcacacagtgggaccacagagatgctgtcatcatttgtgattggctcagggaatcaggcaatgaattgcccattggagaagacaaggaatagaacagagggaagagagagattaaaggttaaaagcactgggcgctgtggcttacatctgtaatcccagcactttgggatgccaaggcgggcagatcacctgaggtcaggagttgaagaccagcctggctaatatggtgaaaccctgtctatactaaaaatacaacaattagccaggcgtggtggtgcgtacctgtagtcccagctactcaggagtctgaggcaggacaatcgcttgaacccaggaggtggaggctgcagtgagccaagattgtaccactgcactccagcctgggtgacagaatgagactctatctaaaaaaaaaaaaaaaaaaaaaaaaaaaaaaaggctggagggagttgtgtgttgcctggcaggtccacgggggacagagatccctcctacccacctgtttccccccagttctgtgccagtggggtcagcggggagatcaggagaaggagctgctggtgggttcagttgctttcgaggtgctggggacaggtggctgcagggagagtgagtgaactgtggggtggaccaatacaagggccaccctgtggggtagtttggggggctatctgggttcagggaacctccacagccccgtccctgcctcccagagcagcaggtacctgcctggggacagcaggcagccaggctgggagctggggggttggggaatctagctactctctcatccagtcccagctactgctgctggccaaggctgtgacctttctcccagatcctggagctgagtaacagttactggaaaaataagttggccatctgggggtggccacagccccatcctcttgggtccccagcctggctgctagaagtgagggtaccagggctgggctgtctgtcccatacaacagtaccatagccaccggtgtgaccagaccaggtacctcctccccgtcacactctatccccaccatgccacacttcccccactgcaggggcctgaaatgacagccccactcccatacccggacaccaaggaaggcgtgatgggtgggtggagaaagagtcccgggcatccctggcagccctgaatgtttcctctggccccagtctcagagacgcccatgcctgggaagagcaagtcagcaacttggcccagaaggagactttgacagcgaggagggctgcatttgaatttcagctctgtcactttttttgcaggtgactgagcaggtcactccttttctctgggcctcagtttccccctctggaaaaatgggaataatgaagcaccctcctggccggtttcgcaatgctcaaatgcaatatggttgtgctgagtgcaaagcgtggtcctgagagggcactcaatacacatgaacgattcagccctaagttctcgaaatatgttcaaggtacccgctgcgggtctagctctgtcctagacacaggagatccagcagcaaacaaaagtgacactgacacctgtccttctcgagggtttgggactccagggagagacacaaaccgtgaattaaaatgttaacgttcaagaaggatgaatgctataaagagaaatgaaactatcgttagatcttattattgttgtgactgttactgttgatacccaattgatcgtgattatagccctgattccagcttccacagttattggaggtatgcaattatttagcaccaactgtgtaccaggctccaaatacctatagccccacaaaatcatttcccagaagagaaaccaaggtctcaggtctgtccaagattgtgagctggttgtgcagggcaggcctgggagtggatctgccagatggcacgattcccggacctgcccccacctcccagggggagctggcatcctcccagctggacctggcccccccttggagcttccccaacctggggatacagaagggcccccacggggagggaggcagccagggcaggcagtggcacagagcaaggagggagcagggcgtctgccacccgcccccacggctgcctgggaaacgccacggcctaatcctggctcaagaggacacgttgtaccagagattatataaaccgacctctccctttgtttgtttaattctttcaggctttttccctcatccttctctctttaatcgctctgccaacagggctgggggtggggtgctccgggctaggcctcttccaggagggagggggctgcatacccagcaccccccactctggtcatacccctacctggtttcccagccacccaggcccgctcctcccccagtcacacacaccaagtcctgccggtggcaggggtgtggggctggacaggcttggccagtggagtgagtctgagaggccaaggccaagggcactgagtcaggctcggactctgctgggcccctaggatgtggcctctccacttggcactcagcttcctcttccaaaaaaatgggatccctgtggtcccaacccccaggttgttgagaacacgcccatgcaaggagtgagcatggcccatggtggatgccgggtgagagccgctgcctgctcccagcccacactacagacacccagggaacagtttcgccctcagactggccctggagcaccgtgactgtggtggccaattgggcctccgagatgtccacgatgcctggtgggtgctctgatgtggaacactgggcaccatcacccagagagggcaaccaggggtgtctggctttgtgctcacccaccgctgaccccgagcctggccctggccctcaccaagacccagtatttccatctgtgtcctggggaggccaacacgaacctccccaccatcagggcagtccacccacagaggggcctgggttcccatcctgaccccctcctttaccacctctgccaccctgtgctgcttggttgctctgtgcctcagtttctccatctgtaaagtggggatcatcatagcagtcagaccccccaagaggattaatcgtgttaatccttataatgcatttattcttaatttatattactttttttttgtagagatgggcttttcccatattgcccaagctggtctggaactcctgggctcacgtgatccacctgcctcggcctcccaaagtgctgtgattacaggcatgagccaccacatctagctatgcattttagaacgggccctcacgtatattaacatgaaagtatctgctaactaaaagaaaataacagcaacagaaataagtaaagaaatggccagttgcagtggctcacgcctgtaatcccagcactttgggaggccgaggcaggtggatcacctaaggtcaggagttcgagaccagcctgaccactatggtgaaaccccgtctctactaaaaatacaaaaattagctgggtgtggtggcgtgcacctgtagtcccagctactcgggaggctgagacaggagaattgcttgaacccgggaggcagaggttgcagtgagctgacatcgcaccactgcactccagcctgggcgacaaagtgagactcagtctcaaaaaaaaaaaaaaaattaaaattaaaaaaaaaagtaaagaaagaatccaggcccattgcacacatgggaaactgaagttgatgttcccaaagcaagtcagaggcagggctgggagctgagaaatcagctgggaacctctcaccctacacctccctggagcccagtggagggaggctgggggcaggggacagagaactgaggtcatggtgccaggtcccaaggggcccaggctcacgttcctgcctgatggctgcaagctcccaaacatcccactctgagcctctccttcccttctctgtacgacaagccccagggtggcacagggtgggcggggtgttggggtgcccggccactcccagccctttacataacctgcggcacagcaggaaatcaaagtgccaacaactgcctcctcagtaaccgacttcctgtcgttacccacccaccttgggcaccagctgcctgctccctacctccagtggcagaggggtcccatccctgaccccagggtttcctccccaaggaagggcccccgtaccctaggctgctccatcatgcgaccctgagccagtgtccagccagctctggcctcagttcctccatccagatgtgtccctgggctgccaggaccgtcaccctgctcctttcggccactggctgggagactgcatactggctgccccagacctgaggctggaggtcagagggcaaagggcaaaggccaaggaattccctttttttttttttttctgtgacagagtctcgctctgttgtccaggctggagtgcagtggcactatcttggctcactgcaacctcagctcccaggttcaagcaattctcctgcctcagcctccctagtagctgggattacaggcatgtgccaccatccctggctaatttttttttttttttttttgtatttttagtagagacggggtttcaccatgttggccaggctggtcttgaactcccgacctcaactgatttacctaccttggcctcccaaagtcttaggattacaggtgtgagccaccacacctggctggaattcctttttttaatttatttattttattaatttatttatttatttattttgagacagagtatcactctgttgcccaggctggagtgcagtggcgtgatctcggctcattgcaacctctgtcccccaggttcaagcgattctcctgccccagcctcccgagtaactgagattgcaagtgcacgccaccatgcccggctaacttttgtatttttagtagagacggggtttcaccatgttggccaggctggtctcgaactcctggcctcaggtgatccacccaccttggcctcccaaagtgctgggattacaggcatgagccaccgcaccggcccagaatttcctttttagagcgagagaagcaggagttgcctctcccattgagggagggagactctggttcttcagggcttttcaaagctgtgggtaggcggtagagggcgccccccacccagtggtgcaaagaggagaccccagccctgctctggaagggagtgagggattggggggaaggtctctggggcaaacagcacttagtgacagccacagtcatatgactgtccgcattttacagatagggaaactgaggcatgaagcaaggccgccatctgcccaaggtcccgtggtctgtaagtggtagagccaagatttgaacctctgaagacaggggtgttggtggaggtgtcagggaatgggacctccgtgggctctgtggg

SEQ ID NO: 136 - DNA, 1854 bp, Homo sapiens
  source 1..1854: mol_type = genomic DNA
taggatgttgcaatcatcatctttaaacattagacatggaatctttataataatcttgccatatatatatatatatatatattttttttttttttttttttttttttttgacactgagtctcactttatcgcccaggctggagtacagtggcacaatcttggctcactacaacctccacctcctgggttcaagtgattctcctgcctcagccaccccagtggctggggactacaggcgtgcaccaccacatccagttaattttttttttttttttgagacggagtctcgttctgtcgcccaggctagagttcagtggggagatctcagctcactgaaacctccgccttgtgggttcaagcaagcaattctctgccacagcctcccgactagctgggattagaagtgcccaccaccacgtctggctaatttttgtatttttagtagagacggggtttcatcatcttggccagactggtcttgaactcctgaccccgtgatccacccacctcggtctcccaaagtactgggattacaggcgtgagccactgcgcctggccggttaatttttatattttcagtagagacaggatttcaccacgctggctaggctggtctcaaactcctgacctcaggtgatccacccgccttggccactgtgcctggtcaacagtctttctatttttattctaggctggagacctttgtctcaaaaacaaaacgagaatgctccctggagtctgtactgatccctcttccctcccaccgtagattagttttctccttgcatttaaaaagacctttctggctggcatccagtgaatgaattgtggaggagggggagaaggagagaggaagcaggtagctcagtggggaagctactgcaaaatcctggcaagcaatgacagtaccttgaatcagggctggtgtcagttggatcagggtggtagggaaaggaggaaatggataaatttggaatgtatttggaggtagagccagcaggatttgctgacaaactgggtttaaagtcaaagagagaaatcaaggttaaacctgacaaataaaaacagatgtggtctcaggcgagtagagacattatgcagaaagactattgcatcagggggaaagatggctgtaaaaacaatgaacaagaccagaatctgataacccagaaggatgtgttgtctaatgaaactaattttttcccctcctcctattttttttttgagacggagtttcactcttgttgcccaagctggagtgcaatggcgcgatctcggctcactgcaacctccgcctcccggattcaagcgattctcctgcctcagcctccctgagtagctgggattacaggcatgcaccaccacacctggctaattttgtatttttagtagagacggggtttcaccatgttggccaggctggtctcaaactcctgacctcaggtgatctgcccacctcagcctcccaaagtactgggattgcaggcatgagacaccgcgcccggcctctcctatattttgttgtcatcagcaagtgaaaagatggtgataccttttacagaggtaaggaaggaggtgagagaaagtattcccagatggggtgggaagctggtacagcccactttgcaggaggtgggggaatcgggaattcttttatatccatgaagtttgagatgtctgttagctctcccaggggtagaacagagggagcagataggctcaaggttggatttggaacgtcctagaaaccttccagaacaaggcaaaggaggaactgagaactggcatttacttcatagcaagagcgtatgagcctccccacccctcctcctttggcttcagggcacccctgga

SEQ ID NO: 137 - DNA, 4757 bp, Homo sapiens
  source 1..4757: mol_type = genomic DNA
ccttccgtttttacccctcaaaaataacttctttcctggcttataacatcgaagtctagttttgtgtgttcttgattttttttttttttttgagttggaatcttgctctgtcacccaggttggagtgaaatggcatgatctcggcttactgcaaacttcacctcccgggttcaagtgattcctgtgtctcagcctcccaagtagctgggattacagatacccgccaccatgcccgactaatttttgtagttttagtagagatggggttttgccatgtcggccaggctggtctggaactcctgacctcaggtgatctgcccacctcggcctcccaaagtgctgggattatagatgtgagcagccattcctggccttattgagatcttttacaatctgtttttttggtactaagtctttgaaatccagtatgtgtgtcattttcacggcccatgttaatatggactcactgtatttcaagcactcagtgcccagatgtggctggtggctgccgtaatgggcattgctggtctggatcttgaagaagaggatgaagggacactggcacaaaagttaccaacacaggccaggcgcagtggctcatgcctgtaatcccagcactttggaaggccgaggcaggtgggtcatctgaggtcgggagtttgagaccagtctgaccaacatggagaaaccccatctctactaaaaatacaaaattaacctagcgtggtggcacatgcctataatcctagctactcgggaggctaaggcaggagaatagcttgaacccgggaggcggaggttgtggtgagccgagattacaccattgcactctagcctgggcaacaagagcgacactccatctcaaaaaaaaaaaaaagttaccaacataaaaaatggtgtgtacacactctgtcctgcaatttcatttctagagagtcatctaccataaatacttgtacatgcatacgagaatatatatacaaaggtgctcattatattataacccaaaatattggaaaccacctaaaatttcaccattagggaggtgattgagtaagcaaatttaaaactaacaacagacttcttcttcttttccttcttcttttttttttttcttttgagacggtgtctcgctctgtcgcccaagctggagtgcaatggcgcggtctcggctcacttcaacctccacctcctggttcacacgattttcctgcctcagcctcccaagcagctgggattacaggcgtgtgccaccacgcctggctaatttttgtatttttagtagagacagggtttcaccatgttggccaggctggtctcgaactgctgacctcgtgatccacctgcctcggcctcccaaagtgctgggattacaggcgtgagccaccgcatccggccttcttcttcttcttttcttttttgagacagggtctcgctctgtcacccaggctgggtgatcatagacagtggtgcgatcatagctcactgcagcctcaatctcccaggctcaggtgatcctcccacctcagtctccagagtagccgggaccacaagtgtgcaccactacacttggctaatttttgtattttttgtagacatggggtttcttcatgttgcccaggctggtcttgaactcctggcctcaagcaatcctccctccttggcctctcaaagtgctgggattacaggcgtgatccactgcacccagctaaaggatttcttatgctgttaaaacagaacaaagtgttttaaaatgtatttacaaaaacatcattctgacgccaggtgcagtggctcttgcctgcaatcccaacactttgggaggctgaggtgagaggattacttgagcccaggagttcgagacaagcctgggcaacatagtgagacccccgactctacaaaaaataataaaaccaaaatgaaaaccaaaacgttatccagaaaaacaaagtgataaagtacattactggggcccagcatggtggctcacacctgtaatcctagcactttgggaggtcgaggtgggaggatcacctgaggtcaggagttcgagaccagcctggccgacatggcgaaaccccatctctactaaaaatacaaaaatttggtggctcatgcctgtaatcccagcacttcgggaggccaaggcgggcggatcacgaggtcaggagatcaagaccgtcctggctaacacggtgaaaccctgtctctactaaaaaaaaaaaaatacaaaatattagctgggcatggtggcgggcgcctgtagtcccagttactcgggaggctgaggcaggagaatggcgtgaacctgggaggcggagcttgcagtgagccgagatcacgccactgtactccagcctgggcaacagagtgagactccatctcaaaaaaaaaaaaaaaaaattagccgggcgtggtggctgggcgcctataatccaagctacttgggagactgaggcaggagaatctcttgaacttgagtggcggaggttgcagtgagccgagattgtgccactggactccagcctgggcgacaaattgagactctgtctcagaaaaaaaaaaaaaagttattggaacaactggtgaaatttcagtgagggctgagtatagtgtggtatcagtggcatatttccttattttgataaatatattgtggttatgtcagagaatatcctgtcataaccgcaatataagagatacacagtaacaaatttatggtaaaggagcatgatgtttccaaagtactctcaaatgattccaggaaaaacataagtagacatagatatatacgcctgtattatttttctagggtttaccagcccccacaattgcatgagccaatttctttttttctgtgtgtgtgtgacaaagtttcgcccttgtcactcaaggctggagtgcaatggcacgatctcggctgactgcaacctccacctcccgagttcaagtgattcttctccctcagcctcccaagtagctgggattacaggtgcccaccaccacacctggctaattttttgtattcttagtagagatggggtttcaccatgttggccaggctggtcttgaactcctgactttcaggtgatccacccgccttagcctcccaaagtgctgggattacaggcgtcagccaccgtgcccggcctctgtctttttttttttttttttttcgagacagggtcttgctcttttgtccaggttgcagtgcagtggcacaatcataggtcactgcagcctcgacctcctgggctcaggtgatcctcctgcctctgcctcctaagtagctaggactataggtgtgctccaccacacctggataattttttgtgttttgtagagatgggggtttcactatgttacttaggctggtctggaactcctggactccagtgatcttcccaccatggcctcccaaaatgctaggattacaggcatgagccattgcttctggccccaattgctttctttttctttctttctttttttttttttttgaggcagagtctcactttgtcgcccaggctggagtgcagtggtatgatctcggttcactgcaacctcttcctcctgagttcaagtgattctcctgcctcagcctcccaagtagctgggactacaggtgcctgccaccattcccagctacttttttgtatttttattaaagacggggtttcacaatgttggtcagcctggtctcgaactctttacctcaagtgatcttccctcctcggcttcccaaagtgctgggattacaggcgggagccaacgcacccggccgcttttactattcttgcaacttttttcatttgacattccatcgaaataaaaagttaaaaaaattctttttcttctgagggggtgttttatcaaggacacctttatcaagggtcccgggcctaaaaatgttaagaacccatgatttacggctgaggaggcaacttccatccaaaatcctaaaagtcaagttcctgtgacctggcttcctgaacctccccgctcctgcgccccctggaggtcagggctagaacaacacggcattcctataatgctccaaatcgccacaaatcgaccttggaaatcctgggtgagtaacgcagactgcgcacatggcttcaattagcggaactaaaacttgctgaacatcgtgtacccgcgtgtccatggccaaacacaaactccacctttgtaaaagtctaggtgaattcccagctgaattcagaagcgtgacaggaatgggacttttcattggtgtctttttcttttttctatttttagagtggggaggagtgtatttctggattgtttaaatatttacaatgagcatgcatttcctttgcaattaaaagaaaaccagatttttttttttttttttttgaggcagaatgttgctctgtccccaggctggagtgcagtggcgcgatctcggctcactgcaacctctgcctcccgtgttcaagcaattctcctgcctcagcctcctgagtagctgggactacaagtgcccgccaccacgcccagctaatttttgtatttttagtagagacggggtttcaccatgttagccaggatagtctcaatctcttgaactggtgatctgcctgcctcggcttcccaaagtgctgggattacaggcatgaggaccgcacccggccgaaaaccagatttttaaaaattgaagtttgctgtagaaaaatactgtgggagaaagttgtgggtggtgttttgtagagtcgcagaaggacatgggaaaa

SEQ ID NO: 138 - DNA, 4547 bp, Homo sapiens
  source 1..4547: mol_type = genomic DNA
ggaatgaaggagggactgtgggatcaagaaacataattctttgagaacataatgtgaaataatataaataatatcaacctcaagagaaatgtagaggaatactatgaattgcagctggaatctgccctaaatgtacatttcttcttcctggtgtttgtgacaatttgagttggggttttcttttagtcacagctgaaggcatcctgatgtgctagcataaacaagatgagtgtcttgcttttgatgcttttagctactcaagccagtaaattatcattcttgtttgaactgtgtgagaggtggtcaagttcaacatttgaagggagagttgagagatactgagtgggagagagggataggaaaaacatgccttctttctgtttaggtttctaaggtgataggagataagcctggagctgctcgtggtcaccttgccaccatggggggagaacctgccagaaaatgaaactaaccaaaaaggaagctgagctaagaggagtgaccagattactgacatgtctcttaaacacctggatccatctgttcctgaaggcaaaactgttcaattacataggctaataaattccctttcttccttaaacaaacagaatactcttggctggaaatgaatctctatcttataccagaaattatttaaaaatccagatggatcaacagccgggcacggtggctcacgcctgtaatcccagcactttgggaggtcgaggcaggcagatcacgaggtcaggagattgagaccatcctggctaacacggtgaaaccccatctctactaaaaatacaaaaaattagccgggcgtggtggcaggcacctgtagtcccagctacttggggggctgaggcaggagaatggcgtgaacccaggaggtggagcttgcagtgagccgagattgcgccactgcactccagcctgggtgacagagcgagactccgtctcaaaaaaaaaaaaaaatcctgatggatcaaagttttaattgtgaaaaaaatcgtaaaagtactagaataaaatatagcagaacttttttttcataatcttcggggtgaagaaggcctttgttagcatgatagtagatccaaaaactataaaggaaaatacagatagattaaaatacctaaaaatttaaaaactctgtataacaaacataaacaaaattgaagagaaactgggagaaaatattagtcacttatataccaaagtgttaatatgcgtaatatataaggacttgccgttataaatcaatacaaaaaggcttctcaattaaaaatgggcaaaatacataaataggcaattcacagaatagaaaacatcaataaatacataaaaagataatctcacaaccaagaggacatttttacctatcagattaaaattgctttaaaaaatgactaacaccaagtatttgggaaggaagtaaagaacagagaaataggcactcatatacacttccaggagttgtgcaaattgtttcaccccttttggaggactatttagaaataactatgaaaaatttaaatgtaggtgttctgtgatcccacaagtatacttgtaggaattcattttgtacatatgtcaaataataaatatccaatgatggaaaagaaaatgaaagcaacttaaatatccattaacagggattggttaaacaaattaaagaaaccctagcatgaaatattacacagctgtgaaaaatgaagatacctatgcatgtatatatttttgtgtaatatgtacaatatgtatatattttgcattatcatgggaaagtatccacattatatcaagtgagaaaagtaacttcttaaaattatgtttgcatgtggttatgccatatataccatacatatgtgaatatatatacatataaagtcagtttcataaaaacagaaagggagatttcttatttatagaaaaagtatgaaatctttggaatgaagttttttttttgagatggattttgctctcgttgcccaggctggagtgcaatggcacaatctcagctcactgcaacctctgtctcccagcttcaagcgattctcctacctcagcctcccaagtagctgagattacaggtatgtgccaccacacccagctaattttttatttttatttttagtagagacagagttttaccatgttaatcaggctggtctcgaactcctgacctcaggtgatccacatgcctcggcctcccaaagtgctgggattacaggcatgagccaccacactcggcctggaacaaagatttacagggcactaaagatttcttcatttttgtatcatctgagttattcacaatgaatattacttcaatcatgaaagaagccacaaaagattaggagaaatacctgggcgataactttaaaatataatagcacagaagaaggctagtgagacatagccccatatattgacagacgttccagctgatacagaacttctggcaacccattggcaacatactcgaggtcacagaaatcctctccctatgaccccatgacctcactgccaggatttcacctgggaaatagttagacactcatccctttcataaaagggatgttccatactatatatatataaaagtcaaaagcggccaggtgtggtggctcacgcctgtaatcccagcactttgggaggctgaggtgggtggatcacgaggtcaggagatcgagactatcctggttaacacagtgaaaccccgtctctactaaaaatacaaaaattagccgggcgtggtggtgggtgcctgttgtcccagctactcaggaggctgaggcaggagaatggcgtgaacctgggaggcggaggttacagtgagccgagattgcaccactgcactccagcctgggtgacagtgaaactccttctcaaaaaaaaaaaaaaaaaaaaaaaaagtcaaaagctagaaacaaccaaaatgtccaacaagggactggataatatgctggctgaatatatataagctacgtgaaactgcaaaatatcaggttgttaaaggtgacttaatgatatgttaaatagctgacactcattgctataaaaatgtagtgcatccatggtccgcatgcccagccatggcaggtaggttaagttcagccctttggaaagcaatatggcaacttgtgtgagtaatcaggaaaatggctggaaccttggttcccatcattgccactgtgggaattttactttgaggaataatcaccccaaagggagagaggaagtgagcacggacatgttcattataacattatttgtaattgggataactggtgaaaaacccatgtcagtcaaaagcttaaagaagaatctaaatggagaatggatttgtaaattacaccttctcagtggcatatcattatccttaataatgataaaagtgtatggggacaatgacaatgctcatggcataatgacggcaaaaacggtctctgcattgtgattacaatgaaataaacttatatttgtttaaaagatttgaaaggaaatataaaaaataaaaacaatatgacttctaaggatggccaaattgtcagcgatggcttttatgttttcaacccaaaatttctgacaactaaacctatggatatgggatatagatttaaaaaaccataaagaggccaggtgcggtggctcacgcctgtaatcccaacattttgggaggccaaggcgggtggatcacacaggagttcaagaccagcctggccaggatggtgaaaccccatctctactaaacctacaaaaattagccaggtgtgatggcaggtgcctataatcccagctacttgggaggctgaggcaggagaatcacttgaacctgggtggcagaggttgcagtgagccgagatcacaccactgcacttcagcctgggcgacagagtgagactttgtctcaaaaaacataaagaaacacacccaagaatgactggtgagtctctctgagctgcagaattacagggaatttgtcttttatttcatacttctttacactttccaaattatcctttatgataagcatatggtatttcactaaatttttttctgttataaaaatatatggccgggcacggtggctcatgcctgtaaatcccagcactttgggagactgaggtgggtggatcacgaggtcaggagttcgagaccagcttggccaatatggtgaaaccccatctctactaaaaatagaaaaattagctgggcatggtggtgcacacctgtagtcccatctacttggggggctgaggcagaagaattgcttgaatctgggaggcggaggttgcagtgagccgagatcttgccattgcactccagcctgggtgacagagcaagactctgtctcaaaaaaaaaaaaatatatatatataattattaaatgaaaaataatactatgttttaaaaatatgactaaaagtctccccttgggaggtggggcttacagtgagccaaggtcacgccactgcactccagcctgggcaacagattgagactctgtctcaaaaaaataataacaaaataaaaaatctcccctt

SEQ ID NO: 139 - DNA, 2234 bp, Homo sapiens
  source 1..2234: mol_type = genomic DNA
caatgaatattacttcaatcatgaaagaagccacaaaagattaggagaaatacctgggcgataactttaaaatataatagcacagaagaaggctagtgagacatagccccatatattgacagacgttccagctgatacagaacttctggcaacccattggcaacatactcgaggtcacagaaatcctctccctatgaccccatgacctcactgccaggatttcacctgggaaatagttagacactcatccctttcataaaagggatgttccatactatatatatataaaagtcaaaagcggccaggtgtggtggctcacgcctgtaatcccagcactttgggaggctgaggtgggtggatcacgaggtcaggagatcgagactatcctggttaacacagtgaaaccccgtctctactaaaaatacaaaaattagccgggcgtggtggtgggtgcctgttgtcccagctactcaggaggctgaggcaggagaatggcgtgaacctgggaggcggaggttacagtgagccgagattgcaccactgcactccagcctgggtgacagtgaaactccttctcaaaaaaaaaaaaaaaaaaaaaaaaagtcaaaagctagaaacaaccaaaatgtccaacaagggactggataatatgctggctgaatatatataagctacgtgaaactgcaaaatatcaggttgttaaaggtgacttaatgatatgttaaatagctgacactcattgctataaaaatgtagtgcatccatggtccgcatgcccagccatggcaggtaggttaagttcagccctttggaaagcaatatggcaacttgtgtgagtaatcaggaaaatggctggaaccttggttcccatcattgccactgtgggaattttactttgaggaataatcaccccaaagggagagaggaagtgagcacggacatgttcattataacattatttgtaattgggataactggtgaaaaacccatgtcagtcaaaagcttaaagaagaatctaaatggagaatggatttgtaaattacaccttctcagtggcatatcattatccttaataatgataaaagtgtatggggacaatgacaatgctcatggcataatgacggcaaaaacggtctctgcattgtgattacaatgaaataaacttatatttgtttaaaagatttgaaaggaaatataaaaaataaaaacaatatgacttctaaggatggccaaattgtcagcgatggcttttatgttttcaacccaaaatttctgacaactaaacctatggatatgggatatagatttaaaaaaccataaagaggccaggtgcggtggctcacgcctgtaatcccaacattttgggaggccaaggcgggtggatcacacaggagttcaagaccagcctggccaggatggtgaaaccccatctctactaaacctacaaaaattagccaggtgtgatggcaggtgcctataatcccagctacttgggaggctgaggcaggagaatcacttgaacctgggtggcagaggttgcagtgagccgagatcacaccactgcacttcagcctgggcgacagagtgagactttgtctcaaaaaacataaagaaacacacccaagaatgactggtgagtctctctgagctgcagaattacagggaatttgtcttttatttcatacttctttacactttccaaattatcctttatgataagcatatggtatttcactaaatttttttctgttataaaaatatatggccgggcacggtggctcatgcctgtaaatcccagcactttgggagactgaggtgggtggatcacgaggtcaggagttcgagaccagcttggccaatatggtgaaaccccatctctactaaaaatagaaaaattagctgggcatggtggtgcacacctgtagtcccatctacttggggggctgaggcagaagaattgcttgaatctgggaggcggaggttgcagtgagccgagatcttgccattgcactccagcctgggtgacagagcaagactctgtctcaaaaaaaaaaaaatatatatatataattattaaatgaaaaataatactatgttttaaaaatatgactaaaagtctccccttgggaggtggggcttacagtgagccaaggtcacgccactgcactccagcctgggcaacagattgagactctgtctcaaaaaaataataacaaaataaaaaatctcccctt

SEQ ID NO: 140 - DNA, 344282 bp, Homo sapiens
  source 1..344282: mol_type = genomic DNA
ccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaagccaacttggtcttgtgttttctttctgggaagatttttaataacaagtttgttttctttaacagtgattagactcttctgttttttggttttttgttttttcctatctgtcagttttggtaaactgaatttcaaggagtttggccatttcattcaaactgtcaaactcatcggcataaaatagtataataactgtttaaaagttataaaacagcatgaaacttggctgggtgcggtggctcatgcctgtaatccaagcactttgggaggccaagaagggtggatcacctgaggtcaggagtttgagaccagcctggccaacatggtaaaaccccatctctacttaaaatacaaaaattagctgggcatggtggtgcacacctgtaatcccagctacttaggaggctgaggcaggagaattgcttgaacccgggaggtggaggttgcagtgagccaagactgtgccattgcactccagcctaggggacaagagtgagactttgtctgaaaaaaaaaaagtatgaaacttgaaatgctttcttttatgtatttattaatttctgatttttgttcttcttgttgttattatcctagagcacagcctttggagatacagtttcttttaaacaacgaaaatgtaagctctctgaagtcagggattttggtctgtatggtttgctgattgaaccccatcctctatgtgtaaaatactgtctgatatgtaatagacattcattaaatactcattgaataaatgaatcaataaacaatagtatcacctaggtgtcaagtgagaagttttaatgtcaaatcaaaattatctccaacccttattacatgaaccagaccatgtccagtaaacacccatcctcaagcacacaatatttagaaatactcatgtggcttactttttcatcaatttctggttttgagcttctgctttaaggaaagtaccatggctaactgttgcctcacgcctttgttttgaaataaatcaacccacaaaggtactcagccctttactttgcttacaggaaatgaccactcagaaatggtccttcggtgcggaacatactttccggatgcactggcaaaagacagaactctacacgaatatgaggcagtcctgttatcagcgtcctcactcactccaccgcttctccctttccctcctgtttcccctaaagttatttacatttccaacatttccaaaacagagaagtttacttagttcatttgcattcttgactcctataaatgctttccagttcctaagaaaagtataccctttaatgcccgactaagttgtggccatagaaaataaggaacaaagagaaaacgcaagaaggagaaacctggagccaagaacagcatatgaccttgaaacaggagaaccacggcttctagactggctagttaacagccttcctccactgccaggacagaggagtcttactttccttcccactggccttggttaattgcactggaacagtgcctgctgcatcctccccatttttcttttcttcattggaagttgccattgtggattctcagttccaattgcacccttgtgtactggggtcttcagaagctgaggattcttggtgtttatgggacattcaccaccaataaacatttctagacttgctcgaatctggaagtccaaaataaaactctggggatagtgtccatgggaagaacaggaccactttttctgtttggggagaagagtgtagagactgttgagtacccaaaggcgtaagctcccctggagactgccagctgcctacccaatattcttccccctactttattaacaaatgtgggcagcaattcattcagctaaaataatccttttctcagtcatccttccagctaggtgtgggtaaattctaggcagtaagatacaaaaatagtatcacattagtacataaggggctgcctcattattttattaacatagtgtttattgattgattgattgattgattgagacaggttttcactctgtcacccaggctggagtgcagtggcactaatcacggctcattgcagccttgacttcccaggcttaggtggttctcccacctcagcctcttgagtagctgagactgcaggcttgtgccatcatgcccagctaatttttgtattttttgtaaagacagggtttcaccaagttgcccaggctggtcttgaactcctgagctcaagcaatgctcctgccttaccctcctaaagtgctgggattataggcatgagccactgtacgtggcctagagtttattttttagggcaattttagattcatagcaaattgggaagaaaatacagagatttcccataaacccactgcccctacacatgcacaacccctctcattatcaacatccccgaccacagtaatatatttcttacagttgatagacctacgcagatacatcattaatccaaagcccacagtttacattagggttcattcttggtgttttactttcagcgggtgatatggttaggctttgtgtccccacccagatctcaccttgaattgtaatccccataatccccacgtgtcaagggagacaccaggtggcggtaattgaatcacgggggcagttccatgatggtcttgtggtagtgagtgagttctcatgagatcttgatggtttcataagcggctcttcccccttcactgggcacttctccttcctgctgtcttgtgaagaaggtggcttgtttccccttccccttctgccatgattgtaaaagtttcccgtggcttccccagccatgctgaactctgagtcaattaaacctctttcctttataaattacccagtctcaggcagttctttacagcagtatgaaaacagactgtccaggtacggtggctcatgcctgtaatcccagcactttggggggccgagatgggcggatcacaaagtcaggagatcgagaccatcctggctaacacggtgaaaccccgtctctactaaaaatacaaaaaatgagccgggcgtggtggcgggcacctgtagtcccagctactcgggaggctgaggcaggaaaatggcgcgaacccgggaggcggagcttgcagtgagccgagatcgcgccactgcactccagcctgggcgacagtgggagactccatctcaaaaaaaaaagaaaaaagaaaacagactaatacagtgggtttggacaaaagtataatgacttgtattcaccattacagtatcatacagactcgtttcattgccctaaaaattttctatgccctgcctattcacccctacctcctccctatcccctggaaaccactgatattttcattgtctttatagttttttcctgttccaggatgtcatatagtagaaatcatgaagtatgtagccttttacgattggcatctgtcatttagtaggatgcatttaaagtttcctccatgtcttttcatagactgatagctcattactttttagcattgaataatgtccactgtctggatgtaccatcatttatttatccattcacctactgaaaaacatcttggttgcttcccaattggacaattataaataaagctgctataaacatccatgtgcaggtttttgtgtggacagaagtttataacttgtttggataaataccaaagaacatgattgctggattgtatggtaagcatatgtttagttgcatgggaaactgccaaactctcttccaaggtggctgtatcattttgcattcccaccaataatgaatgaggatgttccatgtctttgccagcatttggttgtgtcagtgttctggattttggccatttctaataggtgtagggtggtatctcactgttttaacttgcatttccctgatgatatatgatgtgtatcaccctctcatatgttaacctggcatctgtatatcttctttcttgaggtgcctgttaagggcttggcccatttttaaaatgggctttctgtgtccttattgttgagttttaggagttctttgaatattttggataacagtcctttatctgatatgtctcctgcaacactctcccatagagcagattttttttttttttagatttttttttttttgagacagagtctcactctgtcacccacactggagtgcagtggcaccatcacagctcacagcagcctcaacctcacggactcaagtgatccccccacttcatcctcccaagtagctaggactgcaggtatgcaccactatgcccagctaatcatttattttctgtagaaatgggggtctcactttgttgcctaggctggtctcaaattcctgggctcaagtgatcctcccacctcagcctcccaaagtgctgggattacaggtgtgagccaccatgcccagccagaaattttcaattttaataagaattgccttcttgattctttctttcacggattatatcttttgttttgtaattacaaagtcattgtcaaaccaaacgtcatctagattttctcctatgttatcttctaggtgttttatagttttgtcttttacatttaggtctgcgatccattttaagttaattttagcaaagcatgtaaggtctgtttctaaagttacttttttgcacatggatgtctagtcattccagaaccatttgttgaaaagactatcttttctccattgaattgcctttgctcctttgataaagatcacttgacaatattaatgtgagtctatttctgggctctcttattcagttccattgatctatttgtctgttcttttgcctgtagtacactgtcttggttactgtagctttacagtatgtcttgaaatcagatggtgtcagtcctccaactttgctcttcttgttcaatattatgttggctatactgggtcttttccctgtccatgtaaactttagaatcagtttgttatatccacagaataaattgctggaatttttattgggattgtactgaatccaaagatcaaattgaggaaaactgacatcttgacaatcttgaatcttcctagccctgtacatggactatctctcaatttcttcagttcttctataatttctttcatcagagtgttgtagtttttctcatatagatcttgtacatattttgttagatttttactcagtgtttcatttctgagggacataatgtaaatagtattgtgtttttaatttcaaattccatttgctcactgttggtatctaggaaagtgattgatttttttgtactctgcaaccctgctataatcacttattacttccaggaatgtttgttatccaatcttttggattttctgcatagatgatcatgtcagttgtgaacaaaatagtttttttttcttcctttccaatatgcatacctttttagtttgtttttaattgaattagctaagacttcagcaatgctgaaaaccaatatgagagaagacgtccttgccttgttcctggccttactgggaaagcgtcaagtttcccactgttaagtataatgttagctgtaggattttttgtaggcattgtttatcagattgaggaagttcctctttattcccaggttactgagcatttttaaaaattatgaatgagtgttgaattttgtcaaatactttttctgcttctactgatataactatgtggttttttcattagtctgttgatgtaattgattacattaattaatttttgaaatttgaactagacttgcatacctggcatgaataatttttatactttgttttatacattacattatagtagtttagacatttttgggtttgatttcctaatatgtttttgagaatttttgcatctatgttcatgagagttattggtctgtagttttgttttcttgtaatgtctttaaatggatttggttattagggtgatcgtggatttatcatgagttagaaagtcctccttctgtgtctgtattctcaaagttcctcattctttttaatttttgcattgtattttattggatgaatgtaacaaaatttaatctgaccaaattgcttttgatcttttgctcattacaaaaaaaaagctacaatgaatacctgtgcacacacacattcctttgcatgactgtgtgtttgtctatagaaaaaaattacaatagtttgtaacctaagtgtctatcaacagatgaatgaacaaaaaaaaattgttcatatacataatggagtactattctgccatgaaaaataatgagactctgtcatttgcaacaacatggatggaactggaggtcattatgttaagtgaaatggatcaggcacagaaagacaaactttgtatgttctcacttatttgtgggagctaaaaatcaaaacaattgaactcatggagatagagaatagaaggatggttaccagaaattgggaagggtggcaggagtcgggggagaagtggggatggttaatgcgtacaaaaagaacagaaagaatgaatgaaacctagtattcaaaggcacaatagagtgaatatagtcaatgataagttaattatatattttttaaaaactaaaagagtataactggattctttataatccaaaggacgaatatttgagggaatggatactctattttctatgatgtgattattacacattgcatgcctgatatcaaagtatctcatgtaccccataaatatatacaactactatgtactatgtaccgacaaaaattaaaaattaaaaaaagtaatactaaaaaagatcgtttgtaatttagttgatttctctgctcttatctactatcagagctataaagcccattgccacatcttaggaagacaacttttctgaaaaacaaatagtgatctatttcttgacatgagtgggagtacatgagcattttgttttacacaaatatattaatcttcacgtttatctttttctcattgtgtgtgtttgtgtgtggggtggttgttatagtccacattttaaaagctaagagaaataagtcagctggatgtagcggctcatgcctgtaaccccaccactttgggaggccgaggtgggcgaattgcttgggcccaggagttcgagaccagcctgggaaacatagtgagacctcgtctctactgaaaatacaaaaattacctgggcttggtggtgcgtgcctgtagatccagctgaaggactggggctgaggtgggaggatagcttgagcccgggaggcgaaggcggcagtgagctatgattgtggcactgcactccagcctgggtgacacagcgagaccttgtttcaaataaaagaggaaaaaacgaaaaataagtcaatcgaattcgggtccccttttctttataccagtaaagcttcatagctcctgaaattaggctgcttgaagcaggacacctttcatataggtgctgcaattctctaaattcatacttgctaggacagggagggtcaaaggcagcaggaggaagccatccccggcatgactggctcgggtctcctgggctcgtgaaaacgaactcattagacatcgagctccctcttgtggcagctaaaagaaaacacaaggaaatgcaactcttgcttcactcagttctgtgaccgcattgggagataacccttggaaagcttgattatttgtgggctagctcgcccagaatacatttctaagcacatctgtacaagtaactttgttctttcaatgcagaaagtccccttcattccaaaatgtacattccagagacggtggaggctagagatctctcctgtatctcatcccattctatgagttaccagtgccattagacgaaagaaagtccatgtaaatgcttaggatgctggcgactgttcaactgtgattccattctatctttccatctcatgcctcctgcggctccaaacaccatctagttaactgcgtcccgaatgttgacctacactgatgctgtttcatcagagtcaattggggaggtgtttgtttgtttgtttgtttgttttaatatgggttaggtcactgcaacatcaaagcatcttgatttataaagtttggagcagagcacaataatctgtgtttaatcacagattaactttgttccctttaggtattccctggtaaattgtaatgtgcaatcagattcccctgttttctttttttgttttgttttgtttttgagtcagggtcttgctctatggtcaaggctggagtgcagtggtgcaatcatagctcactgaagcctcaacctcaccagctcaagcgatcatcccacctctgtctcccgagtaggtgggaccacaggaacatgccaccacacggggcttatttctgtgtgagccactgcgcccagcaatgattcccctgctttctagcagttgaataaatactcttttaactagaggacataataagaactaatattagaccatgagaattagaactaatattacctcttggaaacacggatatatctttatggtccacaccatagaacaaatggtcttttttatatgcggtggtaacacagccattgggagggaaacatggggagaagtcctagttaggaaagcaaatttggagagtgaggctgtgatcgtgaaatcacaggtgtggacaagctaagctgtcaatactttgttcttctgaaagaagaggttctcagcaacagtgaacagaattaataatttatcagaaaaaagtcccccatgccctttacacctcaattcttaccacaaatagcaaaccaactaaatctggatctgatttttgtatgtacacacaaagcacataacagttactgagaaacacagtgaaagaggaaggacaacctctgatacaaaaagagccaatatcgcctccaaaaactatgtcccttactctccctccctcaggtcctaacactaacttcctgtcccaatttgtagggaagtaggtgctcaatggttcctcttgcccagtgtgttctcttccagttgaaatggcaatctaggcataaagtttggaagatagagtcaaagaattaactactaatgatggagattttgtgagacccacacagagttgggaggcttgctggttgataaaactcctggcaattcataatgtttcacctattctaagtcacacttgagctaatattataccaggttgtccctgtgttagttatctattgctgcaggcaaatcaccctcaaaacatggcttaaaacaatagtaatctaatttactatctgttacaatttctctgggtcaggaatttggaagtttctggcttgagtgtttctggattgaaatctctcatgagtttgtagtcagatgtgagctgaggctgcaattatctgaaggcttgactgaggctagaaaattcacttccaggtgacataatcccatagataatgagttgttgctggaaagttgcttcctcaccacagaactgctggagtagtctcataacgtggctgatggtatctcccaggatgagtgatctgagggggaaagcgttaaatggaagtttcattctttttatgaactacacttggaagggatatagcattacttctgccatactccattggtcagggcagtcacaagtcctggtccagattgaagaggagggggaaaaaatcctcacttctctgtggaaggagtgggaggagtgtgaattacctgtacagacaacatgtgggatgagataaatatgtaacatagatatcagtggaaaatatagtctgccactgtctctagagatcattctagatagtcaaatcacggtaaacattttaccagtcacgatgggtatctagactatgggaataggaatgtaatttcaagcccagttttaagaaagggcaagattttaaaaatttatataggttatgctgttgtacatcaagtacaatttcttcccagttggcacctcctatcccgttcttgttacagtcaaaaaaccataagaggaagtagatacattcagagaaatctagtttctatccttgatcattctaacatgtttcctgcttctacagtttcagtggcaggaacagaagctgttcctgggatcagcaacatggactttgacttgccaaggccaatctggctacactcactgctgagtgcccaatctgcccacagcagagatggacactgagtccctgatatggcaccattccctgggtaatcacccagctccccagtggcaggttgaacacactggaccacttcccttgtgggagaagcagagcctcgtttttatcgggatagatgttaactctgaacatgaatgtgctttctctgtacataatgcttctgccaaaactatcatctgtggacttacagaatgccttgtccatcatcatggcattccatacagcattggtttgattgtgggattaaattcacagcaaataaactgtggcaatgggtccacactctggaattcactggtcctaccatattgtccattttgagtagccggcttgaaggaatggtaggatgaccttttgaagacttacccaagtaccagctagcaggcaataccttgcagggctggagcaatatcctttaggaagctatacatactctaaatcagcactcagtgtatggtgctctctctcccataactagaatccaaggatccaggaatgaaggggtagaaatgggaattgtatcactcattattacctttagtgatccactagaaaaatttctgcttcccatcctcatgaccttatgctgtgttggctcagaggtcttggttccaaaggaagaaatgtatccacccagcgacacaacaatgtttctactgaactggaaggtaccactgcccatcactactttgggctcctcttgctctgaatcagcaggcaaagaagggagttactgtatggatggggtgactgatcctggctactaagaaggaaattggtatgctactatattatatagagataatgaagaacatgtctggaatatgacagacccattagggcagctctgagtaccaccttgttttgttattaaagtccatgtaaaaccacagctctatcaagcaggactgtaatgccccagatctttcaggaatgaaggtttgggtttccccactaggcacagatgatgaccaactgaggtactagttgagggaaaatggaaaatggattgaggagtgaaagatggtagttataaatactaccatgatcgcagaatcagttacagaagtgaagactatcattttaatgaatatttcttattttgtcatgaacaaatttgtgtgtttcaaaaatttttgttttctttcctcttttgtctcattatcacataacataaaatgtattaataataggtaattttaaatcatggtgtttatattagaggagatcaaaaagaagagagaaggctgggtgtggtggctcacgcctataatcccagcactttgggaggccaaggcgggtaggtcacttgaggtcagtagtttgagaacagcctggccaatgtgataaaaccccgtctccactaaaaacataaaaagtagcctggtgtggtgctgtgcacctataatcccagctacttgggatgctgaggcaggagaatcccttgaactcaggatgcggaggttgcagtgaggtgacattgcaccactgcactgcagcctggacaaagaaaaagaagaagaggaagaggaagaggaggaggaggagaagtataggaggaggaggaggggaaggggaagaggaagacgaaggagaaggaggagaagaagaaacatcacccaaggactctgcatcctcttctggagaaagagtcagtgcatttttggctataaggaagataggtgtatcatgttaggaggaaggaggactttgttcttacctttctttggaaaataaacatgatttaaggaaacgtgtatgggtgactggatgacaagaatggactgtgagggttagctttgtgtgtcaatgcggctaggctatagtgtcctcctcatcaaaaattattatagatgttgcagtgaatttcttttcagatatgatgaacatttactaccaactgactttaagtaaagcagactaaactttataatatgaatgagcctgaaacaaaaaattgagaaattttaagagcagaaccaaggtttccatgaagaagaagaaactctctgtggactgaagcatcaactacagcctgggagtttccagccttcccttcctgatggtctgccctatggatttcagacttactgagccagcttccaaagtctcataaaccaataaatctcatatatatatataagttctatttacctggtagaaccctgactgatatatgttttcagtgctttccccccagagaggtgggaaaaaaggtctactgctctgtaaaaaaccgaacataattattattgctttaaaattcctcatttgattctttatcatctgacatcccaggtacttacactaattatttttatttatctatggaaactctgtaattatgaactgtgttttgaaacgccaataatatctacttaatttctcattgaaataaggctttatattttgctctatttaaaaactgtcatattacttttatcgcttctgtactttctattaaaaatcacatattctgagaaaaaacagaggaatgataaaacattaactaatataaatgagtaggtattgagaggaagagatggaggtggtctctctttttctctctctctctctactgtatcattaaattttttgttattgccatcagcatatatatatgtatatatatgtgtatatatgtatatatatgtgtatatatgtatatatgtgtatatatgtgtgtatatatgcatatatgtgtatatatatgtatatatatgtatataaaatatgttctctaatctaactgaaaaaaaaaaactctgtagcacaaacctccttctgaacgttacaaccaatctctgttctccttgacagcaaatacaagggccactaccacttcagttctctacttcctcatttcacattttcacaacaacccattctatatgggttcctttcctgattactgcaccaggactactcttattatggataacagtgacatctgttgccatgttaccgcactgcaggttcagacatttggtgcttggctaagaatccaatggggggaaatctaccatctctcaggtaacagtggaatcttatgcccctaagcatatatgactcagttgaccagtcctttcatctttgaatagataatgttcctggtgacatcactcgtgtttggtttccctcccacctcagtgacttctctttctcaatttccttgattggcccttttctgacttttaaatattggtgtacccaagggcccaattctagaccccctcacctatttgtgtcaatgtagtcatcctaggtaatttgtccctataacttgaaatcccacctgtccattgatgacccctcccaaatctccatcataatccacaacctcttctcagaagaagtcctgactggtatctacctccctcctctgcatttccacttgaaaatctaactgaagtattttatgtggcatgaccaaaacagaactatcaatctgattcttcccaagaaactgattgccatgttttccacatcatttccaattttagaaaaagtcaccaccctctacctaatatcttaagtaccaaatatgagttattcctgattcttttactgtcatccatcaccaaatcacattgactctatgtcagaaacatcgatcaaatctgtgtgtttcttttctatgcactgctatcacgtgactccaatccacctccatctggatgactgtaatagtctcctaattcttctttctgcttccactcttgctttgtagcaatccatctttacaaacctttttcatagtgtaagcatcatcatgctcctcccctgattaacaccctataatagctgtctattgcactaataaaacaaacatttaaagcctttctctaggaaagcctcatattatctggttcttgcgtattctctcacgtcatgtttcttctcacttattatgatgtaactacactagtagtatttttatttctcaaacacaccaagcttactcttgtctcacagtctttgtactaaccactcctctgcctggaatatttcttctcttgaacttctgaaaccacctttgcaaaactatgaccgagacagtgaaagagctctaatttaatcaactccatcttgcttctaacctccgagctgtccttgttcatttctgggtgtaggctgaactgactttgggaaaaacttagtttgtagtttaaaacaaagatgataacagccctttcccaaagcagacctccttcttccctggggactagattgccttgtagaactaacattagccacaagattagaaattatggtttaggagtcatgcagctggaggctacaagattctgaccctccctaaactgctcctaagatcagtgtttgagatattttgcagactctacacttgatggatcagctggcaccacccagatggataaactggctcatctgatcttgtggcctccacccaggaactgactcactgcaagaagacagtttcaattccctgtgatttcatctctgacccaaccaatcaacactcttggctccccggcttccccccacccaccaagttcttcttcaaaactctgctctctgaatggttggggaggctgatttgagtaataatgaaactccagtctcctgcatagctggctctgcgtgacttactctttctctgttgcaatttccccgccttgataaattgactctgtctaggcagccggcaaggtgaacccattgggtggttacacttcacattagcagttcatgtaattctgatttcagctcacatgtcacctcctcaagatattgttttctgagcctctaagataaagtagcctctcagtcactctccattctagtccatgaaactgtacttattctcttgataaccttcattgctgccttctgtcaatcacaaaattacccttttccctcaatctttacaatcactgatctgagtgcctttgcatttctcactctctgtctcttcatctattgaaacagcctctgcattcacctgctattctgtgaaaggggagtagatttccaccgaatgatgtctgcgccagttctggtagagcttggtaagcatgagttagaaatttggaaaccactggagaatgaagagcaggggaatgtcatgatttgctatgtttttaaaatttttatattgactctgaagccgaatagcaactttcaaaagagtaaatattttccattttaattaagtccaatttatacttttttcttctatggattgtgcttttggtgtcgtgtctatgaactccctgcttagccttaagtcttcactatttcttctatgttttcttctaaaaagttagtagttttgcatttaatatttaaatctgtaatccattttggattagtttttataaaggaggtaaaacttagattgagggttttttgtttgtttttatttatttattttttttcgagacggagtttcgctcctgtcgcccaggctggagtgctgtggcacaacctcggctcactgcaagctccgccctgccgggttcacgccattctcctgcttcagcctcccgagtagctgggactacaggcgcccaccaccacgcccggctaattttttgtatttttagtagagacaggtttcaccgtgttagccaggatggtctcgatctcctgacctcgtgatccacccgcctcggcctcctaaagtgctgggactacaggtgtgagccaccgcgccctgcctagaatctcttacatgttctcactcctaagtgggagttgaacaatgagaacacatggacacagggatggggaatatcacacactggggtctgtcgggggctggggggctaggggagggatagcattaggagaaatacctaatgcagatgacaggttgatgggtgcagcaaaccaccatggcacatgtatacctatgaaacaaacctgcacattctgcacgtgtaccccagaacttaaagtaaaaaagaaaagaaaagaaattattcttcaacttcacattcttctactcactccaaagagtctattgtactccaaagcgtctattaagtatgcccttaacaagctccccatccccagagatatgttcttcatctggattttatattccaccagctgggtccttgctctgggaagttctaggtcctgatctcctggagagagtcactgtcatgtaattttcacagcagaagttagcccaagggacaggaggaggagtaagagaactgaaaccagttggggaacaggaaacagaaagcagagctccttctgatttttaatggccctaagaacacaccaatatactacttgttttaatagcagtggattgttgtgggcccatttaggaactaaagtacctgactgtgtttctcaacctcagtctttgtgggatgcagagattcaaccctctcaacctaaagggccaaggaatctgggtgtccaggacccttctctctccaagggtcaaggtaaagagaggagcaagtactgtaatgatgtcagaggcactggaaccagagcaactccatgttgaatagtagctgggtaaaattaggctgagacctactgggctgcattcccagacagtgaaggcattctaagtcacaggatgagataggagttcagcacaaaaaaacaggtcataaagaccttgctgataaaacaggttgcagtaaagaagccggccaaaagccaccaaaatcaagatggccacgagagtgacctctggtcgtcctcactgctacacccccaccagtgccatgacaggttacagatgccatggcaacgtcaggaagttaccctatatggtctaaaaaggggaggaatgaataatccaccccttgtttagcgtatcatcaagaaataaccataaaaatggccaactagcagccctcagggctactttgtctatggaatagccatgctttattcctttactttcttaataaacttgttttcactttattctatggagtcacgctgaattcttccttgtgcgagatcaagaaccctcccttggggtctggatcaggaccccttccagtaacagaagaattagagggaagcaatgaaaggcagaatgaagacgagaaggatggagaccaaaaccactgagagattgaagggaggcagagaagttgacaggacagagcatccacacccaggcaccccaagattaaccccataatttttggctccagtggaagctcatttgtaggtttctagtgcaaagaggtggtgggctttctgaaatattaggttctatccaagggtatcagagtggtatggagataaatgggaagcagagacagaaataaggtagtccacctaaaagcattattcccaaggctttgtgtcattaaggctgtttacaattttaagtagtttataatttaaaattacacctaacaatggcttaaaccaaagacaacatttatggtttatttgctttccaagaattttgcaagtgagtagtactaaattactttctgtccaaattatatcatttaataagtttattttgatcttttcactttttcatcactattttggtgtgttttttttttcctggaaattgccacctcacggccccaagatagctgccatagctcctggtctcacaatacagcatctcatgccaggaagatagggatgaaatgaaaaaatactgaaaattttagatctgaggcgagatatgttcagatttattttataaaaatttatctttgggtcctaataacaagaagcattttagaagattcccaaggaaggaagggtaagaagtatagatgtgtctaagaggcacaaggaaaccaaaatactgtgtgtgtgtgatggttgggaggggggaattaaaataagggaaatggcagaggacaccattatgcataaaggagaaggacccagatgtcaagagaaaaaaagaggcaaaggaccccacagagactaattgccaaacacatttgcaagtcttttgaagtccaattattcttcctaaaactgggttcctggatgcctctgcatgtttcccataaactctcgttattaaaacataagcagttgggtatggtggctcacacctgtaatcccagcactttgggaggtcgaggtggacggatcaccaggctggtcaggagttcgagaccagcctggccaacacggcgagaccccatctgtgctaaaaatacagaaataagccgagcatggtggcgcatgcctataatcccagctactcaggaggctgaggcaggagaatcacttgaacctgggaagtggaggttgcggtgagctgagatcatgccactgtattccaacctggttgacagatcaagactccatctaaaaaaaaaaaaaaaaaaaacaaaaaaccaaaacataagtaggttttctttcttgctacgaaatggcccatgattaacaaaaatgcctagaggcaagtaaacagaataagagtcttaaaatgaactttcactccaatggggcaaaaatcatctaaggatcgtctcagtcagacatgggtgagactcaaagtatgattcatcctgaggcaaattcctcttcagctgtaagcctgttaaatcagacaattacgtgctttcgaaaatatagtggtgggacaatctaggattgacattcccatatcaaaaaggagaaataggaaggaagaaaggggaaccagatcctgaggaagtccaaaacaatgtggcaaatacattttaaggcctcagtataatgttctttgactccatgttctgctttttggacacattggagctggggttgggccacaacagctctgggcagaaccaccatcatggctttgctgggtgtagctgatgcagcagctctcaggggctgaagtcaggtgctgtagctccccaagggtggtattgcacacaggtggctacactgttctgaggtctcaggggcagcctcacccccagggttccactggacattgccctagtggaggcactctgtggtggccccatccccgctgctgtactgggcattctcttaatgccatcatattgggggagggactctctgtggagagacagagagtctctggagacagccctctccctgagttgcatgcctgcgactccaggtagcaccttccttcaaaatctaaggggaggcagccacaaccccgcagctcatgcactctgtgccctggtggagatgacaccacacagatgtagccttggcttacagcctgtgccatccagagaagtggcctgagccgcagtctggcgtgcttgagccaaagcttggaaggccaaggagtgctatactggaatatggggaatacaatcttgaaattgtttgccgccaaaaccttgaaattgtttgcattctgtgcctgtgatgggcagggaagatgtgaagatctgtgagatgccttcagagtcattcttccattgtcttgatgaatactatctggcttctatccatgctaatctccgtatcaaatgttcacttacccacaccattggtgttctcccctgaacatacttttgcactttttacaggctgagaattttccaaatctttaggttctacttcctttttgattataattgccttttttttttttttttttttgagatggagtcttactctatcacccaggctggggtgcgcagtggcgcgatctcggcccactgcaaactctacctcccaggttcaagcaattctcttgcctcagcctctgagtagctgggattacaggtgttcaccaccacacccggctcatttttgtatttttagtagagacagagtttcactatgttggccaggctggtctcgatctcctgacctcatgatccacctgcctcggtctcccaaagtgctgggattacaggagtgagccaccgtgcctggcctataattgccattttttatgtaactcttttcctgcattttactataagcaatcaagagaagccatgccacaccctcaatgctttgcttagatgtaacttccaccaaacatcttattccatcactcagaagttctaccttccacaaagcacaaggacacagacacaattcagccaagttctttgccactttataatgaggctgtcctttcctacagtttccaataatatttctcattttcatctgagatctcatcagaatgacctacttctacatttctaccaatactctgatcattattgcaatcttcttctgagcctgtagcagaatcaccctcaacgttacattcatggaaatgtagagttttttctagcactcacaaactcttccagcctctcacattacccagttccaaagccatttccacatttttaggtatttctaattataatacctctacttcttggtacaaattagtcttttagcccatttgacctgctataacaaaatctattagagtaagttatgatccacataaatttattactcacagtactggaggatagaaaaaccaacattaaggctgggcacagtggctcatgccaccataatctcagcagtttgggatcgcttgaggccaggagtttgagaacagcctgggcaacatggcaaaatcccatctttaacagaaaaaaaaaaaaaaattagccaggcatggtggcacattcctgtaatcccagctgcttgagaggctgaggcacgagaatcccttgaactcaggaggtggaggttgcagtgagacgagattgcactgctgcactccagcctgggtgacaaagcaagactttctctcaaaaaaaaaaaggaaagaataaaaaaagaaaaaccaaggttaggatgccaacagattccatgtctgatgagggcccattactcatagacagcgccttccatatgtcctcacatggtggaagacagacaagctccctcaaggctttcttacaaaggcactaatcctatttatgagggtgcaaccatcacgctctaatctcctccctatggtcccgccttttaataccataacctagggggttaggatttcccatacaaatctggggaggggagaaacaaacattcagactgtagcagatgcagcaatagtaactttaggaatgtggaatttataaagagcactcattcttccccattccccacagccatccagtctccaaggctggtctactcagcctggacaatctgtctctaagctacgcctcttcttgatcacactattcctgccctgggtagctcttcaagaaccttaccttgatttctggcaacattctccattctaatatctctgtctccaattagaaacattctcaaaggcatccctttgcaggactacagaacaatatttttcagaagcacacacctgacaagtcactgtcctgcttaaatggttattcatgttattatgaagaaattccaagtccttcttgtagcattcaggaccctccaacagatggcttctgccacttgctacacactcagtgtttattgctgtctgcctcaccatctatgctccaataaccgcaggtaacctgctattttttgaccctttcctgcgtgctttcactctcctctgcctggaatgtatttttttttgcttctttatctgagtctttaagattcatcccggatgttatctgcattgcacttggaagtgaccctggaccctgtcagtctcagttagttgttccttttgggaaatctcataatgaaccaggcatctgtctatcactatatacccccactctactgtgactgcttagggaaatggcagaggacaccattgtgcacaaagggtgcataagactatgcttagtcacagtagagtgacgctgtcacctctttacctgggtagtcggcatctccagggtaaggcacatgtctgtttaagctctatgtctgcaggagccagcaagggagcacctcttcagaggcctcatgcaatacccaccaccctttattatactgataagtaaattccattttaatcaggtggcaggtagcaatgtgccactgtcctaggaaagcaatcatgattggcctaagccaatatgagcaacttgtcttttttttttttttttttttttttgaggtaaggtattgctcattgcccaggctcgagggcagtggcatcatcatggctcactgcagcctcaacttccctgacaaagcagtcctcccacttcacctcctgagtagctggaactacaggtccacaccaccacacccagctaatatttttttggttttagagatggggtctcactatgttgcccaggctggtcttgaactcctgagctcaagcaatcttcctgtcttggcctccccaaattctggcattacaggcgtgagccactgtccctgacctttatttttatgtatcggtatttttgttatttcttggccattgattggtctagagatggcatgctctggcaatgaaagacaaggagaggtcctgaagagactctggacaaggtttccctctgtaataaaatggaagaggcatgtgaatgagtcacattttctgcctgtctcatgattctggctcgggagggcctgttgatgcaatgtccagaacagtggcagccattctgtggtcactttcaagaaagccctagaagaaaaccaatatgatgatggagtggaagggtgacattaaactcaatttttgttcaaactccagatctatccccttccaaaactttttttaataataaatttctccatggcttatgtgcttcattggtttactctaccttatcactgaaaacatccagtgaatcagagagaaaatagaaaatagttgactcttgttttgtggctctccactgtttttcatggttctattccttgggcttgagaacaacattctgatggtgtttaaaaactcagaaagagcccatctccttagatcagtagtccatagagcatctccctaggggcagaaggttagggggttaatctcggcaatggtgtggagtgtacagtgtctctcatttaccttccttacctctctacatgctcctagttactgcttctctttgtaactctgaggtatgaaatacctcaaagcatatttgattttgtcacagatttctggcacagggctcttaaaacccttggaattccctgagtgataggagtattatttgttattcataaacagccccttttgatcatagctgagtttatgctaaggagatcatggccttaggatgggactggtcaccagaaagaccaagggattagagggttggagctgtcagccccacctactgatctccaggaaggggaggcagggactggagattgagttccataaaaactcttgaacaatgagatttgatgagcttccacattggtgaacactcaggagtgctgggagagtggctgcctgaagagagcatggaagctccatgcaccacccaaccccttccctgccatatacctgccatatgcctctttccaatggactattcctgaggtatattccttatataaagcaacagatgcaaacaaagtgctttcctgagttctgtgtgccattctagcaatttattggtgtcattggaacacccaatttatagcctgtcagtcagaagtacaagtagccacctgggacttgcaacagatgtctgatctgatctgagaacagtttgtgggagtgagccctttagcttttcggatctgagctgaatccaggtagacagcatcataaccgaatttttaattgcaggtggcccaggtggtgtccccagagaattggagaatttcttggtgtagagaaaaagtatatttggtcagaaggattgtgaaagtagagaatcgagtttttgtttcaccgtgcatctttgtttttttattgtttttcctctcattcttctcaccttggtaattgtttctttcattttcctgaatctctgaaaagaaagggcctggactctcagatttcttggcctttgatatttggaaggatgaactccagtctcccacagaaggctagaggtgaaggaacattcagacacataagtttccaagataaatcgtctgagaacatctccaaggtgtcttctgggaatggtaagaaaccctgagtttgtgtcactggattgattccagctccattgtccccgtgtccttcaactaagtctctgctgaagcctgttctataaaaacagcaagtaagtggtttggactgacctattgtactaggttcgacaaagcaaaccaaatggagtcagtcatactaaaactccacatcaccaaaccaaaactaatgtatctgaacttttgagaaatcaggagagagagaaaatggacaaattcctaaaacaggccagtttcagtgggcatgaacatgaagttctgtctgctttcatctttacaaaaaaaaaaaaaaagcaatctgtggtaacttgacttcaatcaatcagttgttccttattgctgtctctctattcctgctgcacaaaaaaaatgcaacatccagatgaccaatcaggtttttgttctctgtttctgctttctttagccctcctatccctgtaaaaccaacttccttggctctaactatcaaaacactcattttgttttatagcatgacaggctgtctgattccatctttataaccaaagccaattaagatcttaaaaccaaacatataacttcatctttttacaagtacttagagcctgagttgctccacaggaatccaggaactgggcacaggaaaaggatctaagctggtggtaagttggggtctgaaaattttaaagttattgttgaaatgcctgctatatgacagagcccttctaactctggagtagcgtagtccagtgaagaatccacttcgttagtatgaaaacaatgttaactatttcattaacagtgtttaatttggttacatgttccagtaacattctttttttttttttttttttttttttttttgatggagtcttgcgctgtcacccaggctggagtgcagtggcacaatctcagcccactgcaacctctgcctcccaggttcaagcgattctcctgcctcagcctcctgagtagctgggattacaggcacctgccaccacgcctggctaattttttgtatttttagtagagacggggtttcaatatgttggccaggctggtcttcaactcctgacctcgtgatctgcccacctcggcctcccaaagtgctgggattacaggcgtgagccaatgtgactggccaattctttatcatatatgtaattaaataaaatttattactaaaataatttccccaaaggtgttttacttttttaaaaacagtggctacaaaaaaattttgagtcccatatgtagctaaagttaacacattatatttctactggacatgtagcattgtagagatgtagcattgaaggatcttgatagtcctgtggagcttacgtactagtgtggagggtatttaagagagaagataaatgaacaaacaaataaaggagaaaagtatctggtgagataggctgtacctgagcattctgctttgcagagtgggtgaggtgggatctctctgaaataatatttgacctgaaatatgaatattcaggatgagccaggtgcaggaagctcaagacgaagagcacggtaggcagaaggaatagagaaagcagaagccctgagatgacaaagagctgcaagttcaaggaattagagcccagtgggtggagcccagtgtgtctgatgagagtgcagagatgaggtctgagggatgcacagggcacatgtggcagtggataagggaacctaggataagggaacctaagataagggtaacttagaagtctggaagccatcggaaggtattgcgaataacatcaccatcttattggacctttttaaagctcatttggtttctgtctggagaatggatcttaggggagggggcagcaggaccaggaaaaagctatttgcaaggcttgtgcaaatatccaagcctgacagggccatggacaccggtcgtggagatggcaatggctctggctgtgcattcagcatgttctgtagatagaatgagtaagacgtggatggcgttgggtggtgaggaaaagagaaatgaaaggtgagttctagatctggagctttaacaactgaatatttaatctccaaatagatacagaatattggaagagtggcaggtctgggaggcagagaacatcaacagtttggtaaaaccatgtgaggtttggagtctatgggactcccacggggagaggttttatcagacttgagtgccagggagaggccacggctgataatttagatgaaaagacagcataatggtttaatcccagagactggatgatatcatttatagaatgtgagataccccaacatttagagtcaaatttagaatagaaaacaccgtaaattggactaaaaagaggaagagaatcgagctgtagagacgaccaagagtgtattgtgtgcacatatctcttggatatatctcatggcataggaaaaatgtgtttgaaaagggagaaagtgatccaatgggtcctgtgtcattgggatatcaggtcttaaaaactgagaaggactcactggatttggcagcctgggggtcataagcatccttgggaaaatgcattaggtggagtgctaaggacagaagtcaatgtggagtggattaaggagaacagctgaggcgaagaaggaaaaggaagaattagagacattctctttggatgtttggctggaaattctgtcttacagacagaccttacagagaggtcatttggctagatagggttgaagctggaaagaaatatgcttcaaaggaggtttctcttgaaagagagggggcgtgattatgtgatagaatgatctagtagaaatacaattttcaatttttttggtataaaaaatgatcttttatccctcaccacatcccacctcaatctaagtcttaactttctcgtctgtacaatggttatacaaattaaaactaacattaatcaatattcaccgtgtctcagggtgtgttgagtgcttacacatattaacacatcccatccacagagcctatgagaggagttgtgagggttaagggagaagctcttggtgtgtggataatgttcataagtagaagctactattgctataagcatcgttcttgtcctgaccctgagcttcatagtgcagggttcgggattgtaccccacaacacaacacacagcctggtgagggctaagagttctaatttgttacagatttaccgacctatcctagatgatttccatgtctattctttttttttttttttttttttttgagacggagtctcgctctgttgccaagctggagtgtagtggtgcaatctcagctcactgcaacctctgcctcctgggttcaagcgattcccccacctcagcctccagtccatgtctattctatttaatcctcccctgaaaatcagtctttatcaaaaaaccatttcagttctgcagaggggaaaatgggggctcaaagagatgtcactgatcaagaatttacaccatcgaggtgtcagagataagatcagagtagagatctaactgactccaaagcctggtactctttacactgttacagtgacacccaactggcagggggagggggtgggaggtattttgcctcccaggggatctttgacaatgtcttttggttgtcactcctgaatggggagttgctactggcatctctggatagcggccaggggtgccgctaaacatcctactgtgtacagaacagtccaccacaacaaagaattaaccagcccaaaatgccattggtgtcaaagctgagaaaccctgagctacactaaacaatgtccctgggaagacctcagtgaaagtgactgataatgataggaaaaaagaaggaaatgagtaaaagaaataggagaaaaaatttattatacgagggcaggaccctatcctggtaattttggaagaacgcctttcaatggcagcacttgagcgtgcaaaggtagtggctctgttcggtctggtttacaaatcttcctgtctccactgactggctaggtatgatgctgaaaaaactacaggagtccctgggccatggattctccctagtaaaaaagggatgatgatggctgcctcacagtgttattatgagtattagatgtaaacaagtgctacataattgctatcattcttaaagaggctaaatagcccagggtgggaagattctcagattttcatgatcatagaaaattgctgtagcttggctgggcgtggtggctcacacctgtaatcccagcactttgggaggccgaggagttcgagacagcctggccaacatggtgaaaccccatctctactaaaaatacaaaaaattagccgggcgtggtggtggtgcccagctactggggaggctgaggcagaagaattacttgaacccaggaggcgaaggttgcagtgagccgagatcacaccgctgcagtccagctgggtgacagaggaaaaaagggaaccattcggacatttgcccctgaacttgaagtgcgccacaccccactcccactgccagttgccacccccgtcagctctctttctgcctgtcctcttgctcctctgagtgtggcctccagatgtctcatgtacctcccggggtctgtgaatactaaaacctctcgaactttaacactgtcgtcgcctcattgaagccgcacccacaatccaacccacgatgtgaggctgcccgaaagcgacctgggcagttggatcccctcttgatgttcttttgtcctgacctctggtggctgctgaggatggtcactagcagctgagttgatagagaaacttgaagagcttcatttaatactactggcatagcaggcaggcttttggctgtgtcttggacacaatcccaatgtctgtgtgtgtggatgactcacgcacttcctgcatcagacagcccagtcggtctggcccagacggcactactgcttgctggtgctccattttgctgcttcgtgcagcttagtactgctgtcctcagcagttaacttggagattctccagaaattccagtgaccgtggacggctctttgaggctccaggctccccagcagctgcaggagggcagatcctattgtaatgagggtgtttccctgtgggacatcagaaaccctttctgggatcaggcccctgacagggggccactactggagggcatgttgccccttgagccatacatgcttctctggtgacctagggcctcggtagtggtccggcctgtattggctctaagtagcaaagtactggcctccagccagagagagctggccaggatgctgagctggccacccggtagcccatggctcgatcctcagctctacctccatcttgctgatgatagggccatgggccaccaggctcctggggagcagcgattccaccatagtgaagttgaagaggatgacagaatgctggcttcagtgtgtcagtgaaggggagctgggtgaaagggtccagtcgcctaactctaacctgtgacacggcaactgcacctgagtccccagggcaccttgcaagagccggtgctgctgaggccagtgcctccttggttgctgcattccttggtgctatcacttctcgttctcccagcccctcagaggtcgatcgggtcaccctggaaagaaaagcggctgcctacaaggccagtgcaagtggagctcattgttcggttttgaagagaaagtgagattaaagaaagacacacaaagacagagtgtctcaacagcaaatgcaggcatttatgtccagtataaacctgcagaggtgccagtgcccaccactgcttacaggctggggcaattacaggcctgggtgggagaggtctggaagtggagcatggcccgttgcctgggaaaatgttgataacatgttcccatgatgaggcggtttggcacttgttcctgcagaatgtgatagtgatgttccttgggcctttgcccggcagagtgtgataaggatgttcgtgtgccttgtggtcaggtggttgggcaggatgtttctcatggcccgaaaccccatggaatgtttcactttgaccaaagtctgcaaaatggtggggggcttacaaagtggtgcagtttggactaactctcaataccatttttttttcttttttggtaacaatgtgtaaagtgaaaacagcagagtgctactccataccactgggatcttgtccagtaaacatccagagagtgaggttaggaaataaaaagtatataaatattagatgcctagaaatgcaagtcactttaaagattttatgtgaaatagaaaaaaaagagaggagagggactcattgtcttgtaatgggtccttcccagagagaggtgactgtccagtggcaccgggcccttttcctccttccccttttactcttatcaactaggacagaaactaagaattttggcttcaagtggctaaaagactgatgggggaaaaaagaaaatagaaaaaaataacagagagactgacgctctaggcagttacaagtccaagaaaaaagacagaaacttttaactttaagtattgagccaaaaccaggtctagcaaacataatgctggccctagattatttattaatttatgaagaaacttctagatatgggggtgacaaaaggaaattaaatccattatatatgcatatattttaatgtaaatatataatagataaattatgtatacataatatagaaccaaattgaaacagttttacaatttggtttgactggaaattcaaaatccatatattaatttttgtagtaaaagtttatgtaaaaaaagacaaaaaggacactgattggcttttgttcctctacaatataggttctaacttaacttctaacattagcggccggacgcggtggctcacgcccgtaatcccagcactttaggaggccgaagtgggcagatcacctgaggtcaagagttcgagatcagcctggccaacatggtgaaaccccatctctactaaaagtacagaaattaaccgggcgtgatgctgggtgcctgtaatcccagctactcaggaggctgaggcaggacaattgcttgaacctgggaggtggaggttgcagtgagccgagattgtgctactgcactccagctgcacgaattgacaaaatttatggacttcatagtgggattcaaattatagttatacatagggatctcattaaatttacttactctactcccataatcttgagaagctaactaaaattttgaaaaatgagtagacctcactttatctgtagcgtcgcctaaatttcccagtcatacagtcattgctctaaaatattctatgttggacatagattctgtgacacaattaataacaaattaaaattaaagtaagcttttggcacttacaaattggcttgatcaaatgaggccccttagtcccccagttaagataatttattacggcccaatagaagttgaaacagcaccttcaaggattaaaatttattatataaaaccgaattaataaaagcgtgattatcgacaccacatctccatttagcaacccaaaagttcttcctgttcccaaatctgaaaaaaaaaaaattcgtaaaaatgccttacgatggatgactacagcagacgggctgttgagggctgcctcagctcttcagcccagaccagtgacagagctaccaacactgcttcacctcctgcagaggtagaggtacaggcaatgagaggagggggtcagggatattttttagccctttctcatcctaccctcatgccagtcccagctttatctacccttgagtcatattaagccattcaaggatgagtggatgaagtttttaatcaggaaaaaatacttccatgccccccaatttgagagtaagaaatagaaaatgaggctattgtgggtgtcatttctaatttctggacctcagcctgtaccctggggtaagtggaagtggaaaaaaactacaagaaaacagaaagagtggtggggatttgtaaggcttggatgagatagtatatattaaagggaaaacttaattactttacccttaagtgtaatgtttgctgtcacctttttgtatctttctctttttaatcagactgttgaaggtgtcttctattcttactttttaagagttctcttcttctattgcttaaattatgaatggatgttaaatgttttcaaatgtaatatctgccaatattaacatgattatttttattctttcatttacatcgttacagattattttattgtatacaactgtatacaaacttcatatggttcctttcatataataagaatgtaagctgtctgagggcaggaattgtggtctgtattgcttacagatgaatcctcaccctctatgtgtaaaatagtgtctgacatgtggtaggcactcaataaatactgaattaatgaatcaataaatagtgtcacctagatatttaagtgagaaacatttgatgtctaattaaaattatctctgttacaaattattttattaaattaaattaatttaactaaaattaaaataacgtgaaccaagtcatgtctagtaaattctcatcctcatgtgcgcaatatttataaattcccaggtggcttccattttcatgaacaccttaaattttgagtttccacttcaatacagtactctcactaacaactgcctaatgactttgtatttaaataaataaactcataactcagccctttaccttgctttctccacaaaaacactcagaaattgtcaattttgtattgtgtaacatactttcctgatgcactggcaaaagacaccactcaacatgaataccaaggaatcctgttatcaatgtcctctctcactccactgctttactcattcttctcgtcttctctagagttctgtgcatttccaaggcagagcagtttgaccatttcattcacacttttgactcctataaatgctttcaatttccaaaaaaaaaaaaaaaatgtatattctttaatgcccaactaagttgtggccatagaaaatgaggaacaatgaaaaaaatgcaagacagaaagtcaggagccacgaaggacagcgtgagacctctagataggagagccagggcttccagatgggctaattaatagactccctctactgccaggacaggggattcttacctttccttcccactggccttggttaattgcagtagaacagtgtccgctacatctcccttttttcttttcctcattaggagtttccattgtggattcccaattctcattgcatcgtggtatattggggctttgaagctaagtattcttttaagttatgggacacttatcacaaagaaacttcaacataaaacgttggggatctcatccttgggaaggatggctctacttcttctatttggaagaagagtgtaaagggatcttgagtacctgaaggcataattctggccaagactgacagctgcctaaccaacattaatcacccttcttcactgcagtgaatgcttataagggtctgttgcctcggcatccagtctaaatacaagcttaattttctcatacgaggctcagggctcagtcacccttgacacagtttccagttctacaccacagtcacgagtacaagaaaaaaaaaagaggaactttaaatttaagtactgggcagaatccagatctaggaaacgtaatcctagccctggaatacttactgatttatgaacaaacttctaatgggagggtgataaaaaggaaattaaatacatcatatgtatatatgtatataatattttaatgtaaacataggacaaataggtgaattatgtacatttaatatataaccgcatcaaaacaaagttttacaatttgatttgattgggaattcaaaattcatatattaatttttataccaaaaaaattatgtaacaaaaggataaaaaggcactgatttggttttgtgcctttacaacataggtactaacttaacttcaacaacagcaaaaatgctcaaattgacaaaaatttatggactttacattggggctcaaattatagttatatatgaggatctatcgagcacccgattctgtggctgttcggggcgccactatgtaacctgccatgatccctggtggactgaacaaaggggggtgaatgcaggaataaaagacaagagacaaaagagtatatttggaagaaggggtccgggggcaccttgcctctagtggacaaggccctgagctttacacggccctctgtatttattagagaaaagcgatagtgagaaggggggtggaagaagaggtcagttggttggtccagagtaggcttgcaagactgcattctctagatgttccagtagataacttcaaagagcttggcgtcaggaagcgattgccctcagcaaaccttctggcggcaggcacagtcgtgagtttgctcacatcctgtattcatgataaacagtttgctgtttgatcatatagcctccagtggaatgctgagttggtcacgtcccatgggccttcggctccctgcatatccccctgtttatgaattaattgaaagaatgtaagaccaggctgggcagctctcattctccgattggcggtccatccgattttacagactataaacagaagacagagacaaaacaacattactccaagaactacatataagatgttactgtggtactttagataggtccaagggttgaggctctccaggccttcctggaattcagtccagtcttctaaagaaggctgaaattcttgagtgtgcctatttaaatcaagaattttgttttgtaattcactaatatcaaaggtgatgttggatgtgaaagctccttgcaaatgggctttcacaaggtcccacggatactcacttttgttatattctaagttggttacacaaatacgagtgtgattaaaatgacagcgcaattgccgctgcaactgcaagctttatacttgttcccctaaccacagaaccatggatttcaacattgccacttcagtttgtaactcagtgttaattttattctgaagtagcctcgcttggttggctgtacgtgtccaattctctacgtactgagccgtttgaacagaactatgcaaagttacagaggacatcacaacagaagttattagtgtgaccaaggaaacgatagcaaaaattatcatgcctaaggctctacgggcacaataagtaacctgaagtagaagaagtttcacaaaatgcaaagcaggtgtggcagcccaagcctcggacagattaacaggaatccctagcccagggatgcaacctaaaatcatcaaagtcgagatattatgtgttcgcaatgtgctatgattaatgcagtgatataactggcaagatttacaggtcaactgggtattgtttacctggagctggtccttctgagctgccaaaaagacataaggattaaaaacacaaaccacaaattgagtggtgatattctttacaaatgtaacattaagactgtgtcgtgactccagtcggccttctctccatctttgcactcaggctcagctgactcatggctcgtaccggagggactgggcccatggttggccaccccatgtttctccagtctcccattccagggttgcaagcaccttgagggcacccacatggcttgtcaatctcctgtaaacacacaagcataccctcttccccatgtcagtaaatccaccgggcctttccattgtccttcttctggggatttccataacactttcagataaactttcctcttttcctctaacacttgccaatgtctttctgctggagtcttaccatccgtaccaggagtcaaaaattttaaagtaaataaggctaaatgtagttttgattgaggtggtagttggcctcctataccccctttttgtcttttcaacattcgttgtaatgtttgatgtgcccattctataatgccttgtcctctaggattataaggaattcctgttttatgggttatagcccaaagctgtaggaaattttgaaaagcatgactagtataagcaggtccattgtcaatttttaattgtttaggtattcccatatgagcaaatgatgacagacaatgtcgctgtacatgaccagctgtctcacctgtttggcatgtaccatgcagcatatgagaataagtgaaacaaattaagcagttctgggtctagcgtacttttaactgtagcagtttctatgcgaatggctaaatttacaacataagctgaacaagaagaatctccttgcagggtttggtaaagatgtgtaagttgataggtagcaatacctaacatcgggcgtagccaattaatatctcctaataattgctgaaaatcatttaaagtctgtaacctgtctttatggttgacaatgttgattgtagcctgccacgatccctgatggactgaacaaaggggacgagcgtgggaataaaagacaagagataaaagagtatatttggaagaagcggtcagggggcagcttgcctctagtggacaatggccctgagctttacacagccctccgtatttatcaggcaaaagagatagcaggaagtggggggggtggttgctggctagcagcctgattcacagcaggcttgcaagactgcattcttaaaacagtaggcgctagatttctcaatagataactctcaatagataacttcaaggagccagggagtgaggccctccacaaaccttttggtggcagcgcagtgtgagtttgccacatcctgcattcatgataaacagtttgctgtttgatcatatagcctccagtggaatgctgagttggtcacgtcccatgggccttcgggtccctgcagttgataggatctgaagctgtgagctgtaaaacctcacagctgactgcaactagctctgagcattgacctgaaaccccagagatccttattgtttgagtatgttttagtccatagatggcagcatgacctttggaagagccatcagtaaaataagtctgtccacctggaataggtttgtgatgagtaatcacaggaagaatgaaagaatggattttataaaactgtaaaattttgtctgagagtagtggttatctatcacgcccatgaagtctgcgaaagcagtttgccaggcagtcgacatttcccaagctgcagcttgttgctgagagtctaaaggaacaataattttgtcaggatcatatcctgtaagcatttgtgacctatgcctgcccatagtcacaatttgtgtaattaaagaaagataaacttgcaaggttttgactgtttgattagatagaaagaaccattctattactgttacagactagtctataaactggcccaaaagtcctgttggagagtagggggtaggaagaataaacaaaagcaaaggtttttgtggttgtagccatgaggcatgtctctgctgtaacatttgctctacaagctgtaatttggcttctgcctctttagttagttgctgcagggaatttaaagaatctccgtgcagggtttggtaaatatgtgtaagttgataggtagcaatacctaacatcggtcatggccaattaatatctcctaataactgctgaaaatcatttaaagtctataacctgtctttatggagaactactttctgagtccatacacttctctctgtaacaatagttcctaagtattggtatggggaagttgtttgtaccttttctagagctattttgagattccatttagtcaaagcctgctttgtttctctgaataactgatgtaggttttgatctgtaggagcagccaaaagaatatcatccatataatgaatgatgtaagcagtaggaaacatattccgaggcttctttaatgcctgtcctacaaaatgctgacatagcgtaagactgttaagcatgccttggggtaaaactctccattgataatgagaaacaggttctctttgattaatagaaggcacagagaatgcaaatcaaggcttatccttctcgtgtaagggtgtagtaaagaaacaatccttaagatctattactacaagaggccagtctcttggaatagccgctggagatggtgaaagtttttgtaaggcacccatcagttttatgtgtacatgaatagctcttaaatcatgtagtagtcgccatcttccggacttttttggaaaaacaaacactggagaattccaagcttatgtgtccggcatcccattgttcttttactagctgctgaagttgcatcaggttctcctgagataggggccattgatccacccacacgggtttgtcactgagccattctaatagtgaggcagtgggcagaggagaaatatcaatgaccctcgtcagaaatcctgacgtcctagcccttttctatctgtttttccagttactgatattgggttaggatttccttgaagaaattttcctaaacattttcccctctgatatctcatgttcttcaacattttaaatcctgggttatcaaagttttcatttgtaagtctcatattccatgttataagtaagtctcaaccccataaattgatagctatattttcaacataagactgaaaagtacatgactgtccatctggaccaagacaaggtaaaatctcagtgctctgttgaacactttgagctgttcctactcccactagggatgtagaagttaattgcaagggccaggatgggggccaactgtctttagatatgactgacacatcagctcccgtatccataagcccataaaatttctttcctttaatgtgtactacacaggtaggtctattagaggctatgggttgggatagatagatttctcatgtagttgtgctcccaacctctttattttctcatttctcctttcatggagaagggtgtgatttgcagggaataagcaataattgagcagtatattgtcccagctcaaaacccaaagatcttgtgacattaaaactacttgaatttctccttcataatcagagtcaacaacttctgggactacagtaatgccctgtaagttaaggcagattttgcctaaaattagtttcacatatcctgctgataaaggtccccaaatatcagtgggaactttgatgggtttgtctgccccaactaacattacccattctttgactgggagatctaatcctgcactccttgtgttcctggggtgagggaatcaatgtgcctctgggaacccatgcctggaacggggttgaggtctggactgggaatgccctcattgtttgtggggcctgggtccaggcccccatctcatttcccagcaggggggtgccattctgatgaaattttgagcggcactgattagcccagttatttcctctgttacgcaaggacaaagtcctggcattttttccactgggtggggcactgcattgtaaggtcctttctgtactgagatctggcggcattcctttttaaaatgtccaggtttttcacaattataacattttcccactttagggtttgacccttggctccttttagatttgtcaactgctaaattagccactgcttgcgctaatattgcaaagtgatgaagctcagttcctacatcttgacaagctctgagaaaacttcccaagttttttatacacctcaccagtgccagtgcatgtttacaatccgcgtttgcatcctcaaaagctagagttaaggttagcatttctgcagccgtggtatgaggaatctgacgcttcactgcctcttgtgatcttgtaagaaattgcacatagggttcctgtgacccttgcatatgtaaaaaggattgtactgggactccctcttcaggaattgcggcccaggtgcatttaacagcctgtgcacactgctgataagcagcgtctgggagtgccatttgactttccaggtctgaataagggccattacctaatagcatatcctctgtaatgtctccgtgtccagcaacatggttctgtttagcctggtctgcacacatttcttgccaatttaaattccatgtcagatatgcactagtggacaagcaagttcgcatcaagtgtctcacatcaaagggtaaaaaacgcatagcaccaaacacagattctagcaatcctaaggtcaaccggctctgtatgccattatttaccactctcgcttttaattccttcaacaacttactctagtggggtgtgttcatgaataacctgctgtggattgttgggatcaggccttatggaaataggaaaagtgcaaggtcctaggggctctccagctatggcagcagagcataaaattctttgtattggggtctctagttctgctaccaaaggaggcaatacagatgtttctgcaactggaggaggctgtataggccaatttttatcctccctctcctgttttttattttcatctggagctgtgagtgggacaacagattctttcagatttttagattcagcctgttgtcccacagaataataaggagataatggcagaagtacagtatgaactaaactccaagtggagaaaacagaaggatcaattttaagacctttttgatgagcccattttaatccttctgctctgtcccaattttccacatcaagggtgctgcctgtggaaaccatgggttatgtgtaataacctcctgcagcagctaagttaatgtctgagaactaacctgagcaccagtttgtttcaacagaactctaagcaactgcacataattatttttttcagtagacgaattctgccccatgttaccgtgattcagaaaacttcccattcccagtacttctttaaggaactgatcccagtacctctttaggcgctgacctcatgtgcgctgccagctgactcatcccagggtccccatttgcgttgtcaatttcagttcctctattccaggagatcttcttcattcacatcctcatagtcccgtgttcagactgtcgcctgtttgagtgccacttgtagagcccctgattctgtcgctgttcggggcaccactatgtaacgtgccatgatccctggtggactgaacaaagggggatgaacacgggaataaaagacaagagacaaaagagtatctctggaagaaggagttagggggcaccttgcctctagtggacaaggagctcggcaccaggaggcgactcgccctcagcaaaccctctggcagtgggagtagtcgtgagtttgcccacatcctgcattcatgataaacagtttgctgtttgatcatatagcctccagtggaatgatgagttggtcatatcccatggggtcttcggctccctgcaaggatcccactaaatgtactcactttgcccatattgtcttgagaaggcaactacatataaaattttgaaaaatgagtatacctcgctttaactacagccttgcctaaattacccatagtcatacctattgttctaaaatagcctatgttggaggtaggttgctctaaaacagaatatgttggaggtagacataataaataatacattaaaattaaagtaaattgtttgcacttagagattggcttgataaaatgggatcacttagtcccccagttaagatagttaatatggcccaacgtagggtgaaataatggccttcaataattaaaatttgttaaacaaaacgtgattaataaaagggtgactatccacattgcatctccacttaacagcccaaagtgcttcttgttcccatatctgaaaataaaaaatatcacaaagaatgtcttatgatggatgactacagcactaaggctgtagtcccatctatcagggcccccatatctaacatctaatattattaaaaattgctaatactattcaatcaagaactggtaaacattttgctctcattcatttggctagcatgttctgttaagtgcttatttctacagaccctcagctacagttgcctccacctctgaagaaacacaatacacctttccaggctacctaggggtaccctcatagctttggcatcacacacaagctttgcagacaggagcttaatgacatccacagtctccataagcacaggtgcagcattacattgaggacaacctcctctaagaagattcacttgatacacacattacagtcatttaattcgtctcttagtccattcaaggtactataacaaaatttattatgctggataatttgtaaacaacataaatttaggccagacgtgggggctcatgcctgtaatctcagcattttgagagtctgaggtgggtgaatcacctgaggttacaagtttgagaccagcctggccaacatggtgaaactctgtctctacccaaaaatacaaaaattagcaggcatggtggtgaacctgtagttctagctactggggaggctgaggtaagggaattggttgaaccctggagatggaggttgcaatgggccgagatcacgccactgcactccagcatgggtgacagagtgatgctctgtctcaacacacacacacacacacacacacacacacacacacacacaccccataaatttattgatcacagttctgggggctgtaaagtccaagatcaaggtgctagcagatgcagtatctggtgagggccattactcacagacagtgctttctatgagtcctcacatggtaaaagggaaagacaagtgcctataggactcttataaggcactcatcctacctatgagggcagaacaatcataattgaaaacctccaccttttaataccatcaccttggtatgagcaacctcatttatatttttatttttatttttatttttggcccagggaatgatctaaggatgtcatgtttcagtggtgaaagataaggacaggtcctgaagagactctgaaggagtctttataaaggaggatgggatgttttccttttttttgagacagagtctcactctgtcacctaggctggagtgcagtggcgtgatctcggctcactgcaagctccacctcccgggttcacgccattttcccacctcagcctcccgaatatctgggactagaggtgcctgccaccacgcccagctaattttgcttttgtatttttagtagagatgggttttcactgtgttagccaggatggactcgatctcctgacctcgtgatccacccacctcggcctcccaaagtgctgggattacaggcataagccaccgcagctggccgatgttttcctcctttataaaatgagacaggcatgtgaatgaagccagtttttttgtttatcttcatccttctggctctggagggcccgttgatgtgatgtccagaacagtggcagccattctgtggtcactttcaagaagcccctggaagaaagccaataggatggtgaagcaaagggcttaaatgaaaaccaatttttatttagactcagattctatctccttgcaaaactttttgtaatagtaaattccttcttggtttatgtgcttcatatgtttactatactttatcactgaaaacatcctttggtatagtgattcggggagaaaagaaaaaatagttgactcctgttttctgcgtctccacttgtcttcatggttgtgttgtttcagccggaggacaatgtcctgatgttgcttaaaatctcagaaagggcccatctcctccgatttagacctttaactcttctcagattaagatatttgaactaaatttgttgtaattttgtctattaactaatccttagagctgcgttgcaggtcccacaaattatctccctctggagcagaaggttaaggggttaatcttggtaatgatattggataacgggtactctctcatgcatctgcctcacctctcaaggtttttgttttttgtttgttttgtttttttgttttgagacagagtccagctctgtcacccaggatgaagtgcagtggtgtgatctcggctcactgcaacctccatctgctgggttcaagtgattctcctgccgcagtctcctgagcagctgggactacaggcatgtgccattctgctgggctaatttttgtatttttagtaaagatgggttttcgccatgttggccaggctggtcttgaactcctgactcgggtgatctgcccacctcggcctcccaaagtgcagggattacaggcatgagccactgcactcggcctaaaaaccactttttttgtttgtttggtttggtttgagacacagtctcactctgtcccacaggctggagtgcagtggcgccatctcagctcactgcaacctccacctcctgggttcaagagattctcctgccccagcctccaaagtagctgggactacagccgcctgccaccacgtctggctaattttcgtatttttagtagaggcggggtttcaccttgttgcccaggctggtcctgaactcccgacctcaaatgatccgcccacctcggcctcccaaattgctgggattgcaggcgcgagccaccttttatcacatctcattttatgttagtgaggttatttagggcgaggtcccttgataggctcaggttagggctgaccaccacaaaaatcaagtgactagagggttggagctttcagccccacccattgactttcaggaaggggaagtggggactggagattgagctctataaaaaaatgttggctgggtgcagtggctcatgcctgtaatcccagcactctcgaaggccgaggtgggtggatctcaaagtcaggaattcgagaccagcctggccaacatgatgaaactctatctctactgaaaatacaaaaattagccaggcatggtgatgtgcgcctgtagccccagctactcaggagactgaggcaggagaattgcttgaactgcttgaacctgggaggtggaggttgcagtgagccaagatcccgccactgcactccagcctgagggacagggtgagactctgtctaaaaaaaaaaaaggtagacaccaggcacggtggctcacacttgtcatcccagcactttgtgaggccaaggtgggcagatcgctttaagcccaggagtttgaaaccagtctaggatacatggcgaaaccctgtttgtacaaaaaattagtcaggcgtggtatctcacgcctgtagtccccactacttaggaggctgaggctggagaatcccttgagcccagggaagtggaggttacagtgagcagcgatcatgccactagactccagcctgggtgatagaatgagaccctgtctcaaaaaaaaaagaaaaaagaaaaaagaaaaagaagaagaaaaagaaaagaaaagaaattagccaggcatggttccaggtacctacagtcccagcaactcaggaggctgaggtgggaggatcacttgagcccaggagtttgaggctgcagtgagctgtgactgcaccactacaccccagactggggaagagagtgagatcctattaaaaaaaaaaaaaaaacccttgagaaatgagattagatgagcttcttgagttggtgaacacaaagaggtgccggaaggctgagtgcctgaagagagagcatggaagctccatgtaccacctcaacctctcccttgctatatacttgccctatgcatctattttgactgtttttgagctgtattcttttctccttttttttgagacagaatctcactctattgcccaggcttggagtacagtggcatgatctcggctgactacaacctcttcttcctgggttcaaatgattctcgtgcctcagcctcctcagtagctggaattactggcatgtgccactacacccggttaatttttgtgtttttagtagagacaaggttttgccacattggccagactggtctccaaatcctggcctcaagtgatccaccagcctcagactctcaaagtgctgggattactggcgtgaaccaccatgcctggcctaagatgtactctttagaataaaccaataaatgaaagcaaagtgatttattgtgttctgcatgccattctagcaaattacaaagctgatgagggggtcacaggaacccctgatttatagcccatcagtcagaagtacaggtggccacatgggacttgcattggtatctgaagtgaagacagtcttgtgggagtgagacctttaacttgtgcgatctgatgctatctccagttagacagcatcagaactgaatttcattgtaggatagacagtggtgtctccagagaattggagacttgctctgtttggaaaaaagcccacacatatgctgttagaagtatgtgtgtaaatagagaagtgagtttttgcttaatcatacatctttgttgtttattgttttcctctcattttttcaccttggtaattttttgtttcatttccctgaatctctgaagaagaaagggcctggactctcatattccttgacccttgttatttggagggatgaactccagtctcccacagaaggttagaggtgaaggaacattcagacacataggtttctaagatgagtagtttgatgacatctccaaggtgtcttctgggaatggtaagaaaccctgagtttctgtcactggattgattccagctccattgttcccttgtccttcagcaaagtctctgctgaagcctattatgtaaaaatcacaggacaccattggtttaaactgagctactgtactacactcaacaaacaaaaccaaaatagagtcactcatactaaagttctatgtcaccaaaccaaaaactaagttgtttatctggctttccaagaaatcataaagagagagagagagagagaaaatagccaaattcccaaacaggtcactttcagtagccatgaaaatgcctctgctttaatccttacaaaagaagtaacgtaagtaaccatgtcagtcaatctgttttgtttttttttttaaattattgtttccctattcccactgtatggaaaaagcaactttgaaatgaccattcagcttttttttctttgtttctgctttctttagccctcctctccctataaaatcaaacttctctgttctactcatcaatacaggcattctgttttgagggatgaggtgttgtctgattctagaattatgaataaagccaataaaaactttacactaaattagttgtaattttgtcttttgacaaatccttggagcttgtgttgctcgacaggaagccagggactggccacaagaaaaggaactcagctagtggtaagttggggtctggcaatctaaaaattattgttggaatgcctgctgtatgacagacatttcctaaactctggagcagggctgtgcgatgaagtatctacttgccaaatacagcttttttgttttgttttgttttttcagtcttttttttttcttttttcttttctttacttttcttttattatactttaagttttaggaaatgatgagttcacgtcctttttagggacatggacgaagctggaaaccatcattctcagcaaactgtcgcaaggacaaatacagcttttgagtgcttgctatttttctcatttaaccttaagtgtgctataaatataaaatgcatctcatgtcttctaagacttagtatgaaaaaagaacgccatgtatctcattaataatttttattctgattaaatgttccaatgataccctttttgatatataggattcaagaaaatatattattggtgttaatttcccaaatgtttcctactctgtttacacatggttacctgaaaactataagacacaaacacggcccgtgtttacagaccacattgtgtttccattggacagtgctatgctagagacacagcactgaaagaaggtgctacttgtggagtttgtatatcagtgcagaaagtatttatgatagaaaataaatgaacaaacaaataagaaaagcatctggtgacataggctggacctggggcagctgttttgcaaatgggttaagagaatacctctgaggacaagatatttaagctaaaatataaatattcagaaagagccaggtgtggaaaactccagaggaagatcatagtaggcagaaggaagagagaaagcaaaagccctgaaatggcaagaagctggcatggtcagggaatcaaggagtccaccatgggtccagcacagtgtgtcaggtgagagtgcagagatgaggtctggggatacacaagacaaatctcagggtgcttgagaagtgtgagttagaaatgtggaagccatagaagagtgctgagaagaataacatcattgtcttatttttccttttgaaatataatttgtctgtgtctggattttagcagagggaatagcaggaccaggaacaaactatctgcaaagtttgtacaaatatccaagcctgacagggccatggacatgggtagtggagatggagatggctctggctgtgcattcagcatgttctgtagatataatcaataggacttggattgtattgggtggtaaggaaaatgaaaggtgagttctacatttagagctttaataactgaatatttaaactccaaatagatacagaatattggaagaatggcaggtttgggaggaagggacaagcaacagtttagtttgggcaatgttgggtttggagtgtctatgggactgcaggggagatatcaagaagtcaattggttatatgagactagagctcctggggaggccagtgctaataattcagatgagaggatagcatggtactttaagctgtgatactgaatgatatcacctatagaatgtgggacaccctaaatttagagacatttagagcagaaaactggactgaaaagaggtggccaattgagctgtaaagacaaccaagagtggattgtgtgtacatcttatcatcttatgatatggaaaaaaaatgtgtttgaagtaggagaaagagatccagtggttcctatgtcactggaacatcaggataaaaactgagaaaggtccactggatttggcagtctggaggtcatgtgtatccttaggagagtgcattagctggagtgctaaggactaaagtcaatatagaatggattcagcagaataggtgaggtgagaaaaaaaaagcaagcaattagagacaaccatttctaaagtttggctaggaattctctttacagaaaacacttctcttaaagaaatagggttgaagcttggaaagaaatatgggccaagattggtttctttttaaagggaagggataggataatggttacttggtaacaagaaggatctagtagaaatcaaatcttgagggtttctttttagcagaaagcagaaggacaaataccatttcttgggaagacgagagacagtgggatggaaagcaaatgtaaagagggaagtcactgggaaaaagaagtctttattcacaatagcaagggcacgtaaattgagggttaggaaagaaaaggctaaaaaatgcacatctaattgttacagttttctcattaaaattcagccaaggccatcagctgagagtggaatagtagaggaagttggttagtttgaggagaaagcagaagggctgaatgttattttaatgcatcagaaatcacacgtgctggagaagcacagatgctaacaaggaagtgccgagtttccattatagattacattccaatctgtaatcatacatccagttgtacctctcaataattgtgacattgaacaagtcacttcccctctctgagccatggtttcctatggattatacaagaacaatatttgtcccagagcaaggatgttgtaattagaaataataaaatacacattggttgatacacattgggattgcaccaaatagcagccctcataatcagtacaggtatcatctctggtccacggttctcttctccactttgtaactagggtggatccaaaattttacaacattgtcttgttggcctgtccccacctgtcactgcacattgttggaatgtgtcaacatttccaaatgacttagagattattgatacatcatactgtctgaatgtcttctaggatatttggagagtggtagagaaaatctgagtctgttgaggaactagggaatgggagagggttaaccatacaattctgttgaaatcagtctgattgagctccaactctggttctacccctttctgactgggggctttaaataattaatgtaaccaatataagtcaacttcctcatgtgtacaatggttatactaattaaaactaaggttagtcaatattcaccgtgtctcaaggtgtgctcagtgctcacacagattaacacgtctcatctgcagaggctgtgagagcagttgttagggttaaaggagaagctcttggcatgtgagtaatgttcataagtagtagccactattgctatgagcattgttcttgtcctgaccttgagcttcaaaaggcacgacccaggattgagccccatgacacagcacacagcctggtgaggaccagaagttcccatttgtcacagacactcagtctagcctagaagatttccatgtccagtctcacttaatcctcacctgaaagttagacttcaccacaaaactgtccttgttctgcagaggagaaaactgaggctcaaagagatatcactgaccaagaacccatattggcaaggtgccaacgataagagtagcgatctaactgaccccaaagcccagtgttctttactctgtaacagtgatgctcaactggggggagttttgcctcccacgggacctttgacaatgtctatagacactttcagttgtcactcctgaagggggagttgctactagcatcggtggatagaggccaggggtgttgctaaatatcctactgtgcacagaacagtcccccacaacaaagaattacacagccccaattgtctgtagtgccaacgttgagaaaccttgagctacattaaacaatgtcccatgaaagacctcagtgaaagtgactggtaatgacaggaagaaaagaaggaagagagaaagggaaaggaggaaaaaaccatgatactagggtatgaccacatgctggaaatatctggggaactcctttcaaatgcagcattttagagttgcaacggtagtggctctaaagttgctcatcctgaatttcaaatcttgctgcctccactgaccggctggacatgatgctgaaaaaaaaaaacctacaaaaaccccaaggccatgaattccctctggtacaaaaaggggtaatgatggctgcccacaatgttattatgagtattatttgtgaacaagtgctgtataattgctgttacttttagagaggctggatatcccaaggtaggaagagtctctaattttcctggccataaaaatcactgtagcttttacacagagagattctagagttgggttcatgaatatgcattttaacaaataccttggatgtttctgatacagcccacagaccacagtataagcaaatttggtcaagtggcaaagacacaagggacacagagacctttgggttgagttggatgcaacagcttcccatgtgacctggtgcagaggcagggactgtaattttgtgattctgtttcttaaaagcaaggaaatagatcccagaaagatgccaggatatcctcccatagtgttattgcccagaatttagtcatgtttccaccaataaagcaatcccttgcaaagcaaaaggaattctagttagaacaaattagaaaatcaagatatgcccgcaaagatggaggagggataccttcccccaaaagagtgagtaactgaacaaaattgcgatttgatttgcagagaagaaatgaggaacagttatttgtggggggagggggcatcaccagcaatatctgtcagaattgttgcatagagaaagggcttagaagtcagactaagctagattaaagatctttgtctactgtttcctacttaagtgaccagcagatttcacaattgctctcaacattgagtcattcctgtggaaactacaaacaatgaatattacagagctactatgcagaccaaactacaacccatatgtagcaattaacacagtgaatagtctctgataagaaccctacaaatactagctaaatattcatgctcattctgtttatcccacagaccttgaagatatacaacggatgctaagtagggacaatgaaaagcagacgggagaaagtaaatatagggccctctttgttgacttcatctagcacagaatctataggatgtaatatatttctgctctttttttttgtggggggaaatggaatctactctgacatccagactgaagtgcagtggcacgatcttggctcactgcaacctctgcctcccaggttcaagcaattctcctgcctcagcctcctaagtagctggagttacaggctcttgccaccacacctggctaatttttgcatttttagtagagatggagtttcaccatgttggccaggccagtctccaactcctgatctcaagtgatccactctcctcaacctcctaaagtgctggggttacaggcatgagtcaccacgcccggcctatagcatgtaatatatgtctatatattacaagtaatggttcaaaatcctcttcagctaactcaatccaaaccctaaaacttcaaattaaatatcaactaaaaaataggtcaagggtcctcacagtgggagggacaggagctgggagactgggagagcatggggccgaaagaagttgcagagcttgccagcatgtttgcattgagtgatggaggccacagatgtgaaccttctgactctgagtcttgtgccttcctcacgaagctgaagctgcctatgctcaattttccattgtccatacactctcagttcagtatttccgctggtggacagagccctttaatcctcttggtaatcagcttgataggtggcatgcatattaataatgatgggaatatagagaactatcgtttcccaaaggaactccgagagagtgccaattttatgttataaccattcacaaggctcactggggagggtctgctggtaggaggaggagctacagtggaagttaatgaatagttgtattgtaagatggtgtcacagctgagaaatggccattgctgaaatgtttcaggtgtgggaagatggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttggctcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcagcgtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacagacaccacttctgcttcacctcctgaggagacggagttacaagcaatgtgaggtcggggatatttttgggctctgtctctttctaccctgcgttaagcggaaaaaaaaaattctgacagtgtttttcttcctctttcataccaccaccaccacaatcatcaacataaaggaagtctgtaccaaatctgtagggggtttttcccacaaccaagcaatagacaccagctgggtgtcctacaattaaattccaacactatctacctggagctactgtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatattaacgtgatcatattatttttattctttcatttacataattataaattagattaagttttcaatgttaagctacccttgcatttatgaaataaaccacgcttgctcatgatggtttttgaacatttataatctgtctcacagatttgtttagaatttctgtatttatgtttatgtagagatggctctgttatttcacttttctctactgtccttgttagcttttacataaaacttagttttcctgaaaggagtttggaagtgattttctgattctatcctcgggtattatatctttgttaaacatttagaaaaatttgctagtgaagccaactggatcttgggtttgctttttgggaaggcttttaaatataggttcgatttctttaacaattattagacctggcagttttctttttcacattgttcacttttggtaaactgtgattttcaaattcaaggaatttggccatttcatcccaattaccaaacttttgtaatcacccagtgggttctccctgcctgctgcacagacaaaaccagtttactgagactgtagtattgcagtaaagaaagatgcagtattgcagtaaacatgatgctggccacatggatgaactggagttatcagtcaaatcagtttccctcaaggctgagagattatggtttttcaaagatagtttggtgggcaggagactagggaatgggtgctgctgactggttgggaaggcaatcataggagagtggaaagtggtcctcaagcactgagtctgccttggagtgagggggtcacaggaccacttgagtcataagtcatgagccctggtaaggtcagtcagttgctagaatgcaagtctgaaaaacatctcaaaagactaatcctaggttctacaatagaggtgttacctatagaagtgattggggaagtcacaaatcttggtctttactgcccaggtgtctctggccacatgacgtctggcaataaaggattatagaaactataatcctacattttagcagaattcagactccttgaataatcctaatcttagggcctttcattacttttcagtctcagagcaagaagggtgttagttagggaaggcctactatcatccttgcttccatgttaaactataaactaaattcttccccagttatcttagcctacaaccaggagtgaacaaagacagataacctttgaggctagaggcaggaaggagtcagccacgttagatttctctcactgtcaaaatttttgcaaatgtggtttcacttattggcatgagacagtataataactgtatggtacttgatatgtttctttcaagtaatgagaatgtaagctatctgagggcaggtattttggtctatattgtttgctgatggatcccaatcccctgcaaataagatagtgtctgatatgtgataggcactcaataaatgtttatggcattgataaacaataatatcacttaatgtccagtcaaaattatctccagccctcataatatgaatcaggtcaggtctagtaaattcccatcctcatgtccacagtatttgtaaattcccagctggcttacattttcatgaacatttctgattttgagtttctgcttaagtaaactactctggttaaccattgcctaaagacttcatatttaaataaataactcataactcagccctttaccttgctttctgcacataaacactcagaaattgtcaattctgtattgtgaacatactttcctgatgcactggcaaaagacaccactcaacatgaatatcaggcaatcctgttatcagtgttctcactcaccccactgctttactcattttcttctccttttcccttctgtctctcctaaagttattgcatttccaaggcagagcactttgcgcatttcatttgcacgtttgactcctataaatgctttagagttcccaggaggtgtatattcttaaatgcccagccaaggtgtagccatagaaaataaggaacaaggctgggcatgatggctgactccagtaatcccagcactttgggaggccgaggtgagtggatcatttgaggtcaagagttctagaccagcctggccaacatgttgaaacgctgtctgtactaaaaatacaaaaattatctgggcatggtggtgtgcacctataatcccagctacttggaagactgaggaaggagaattgtttgaacctgggaggtgaaggttgcaatgagctgagaatgtgccactgcactctagcctgggagacagagaaagattccatctcaaaaaaaaaaaaaggagaagaaaaagaaaaagaaaataaaaaggcacaaggacaaaacctagataggagagccagggcttccagatgggctaattaagagacttcctccactgccaggacaggggattcttactattccttcccactggccttggttaattgcagtagaacagtgcctgctacatcctctccatttttcttttcctctttaggagttttcattgtggagtctcaattcccattgcattatgatatattgtgggttcaggaaactgagattttttttttaaagttatgggacagttaccacaaagaaatacttcccaatgtatgtccatgtggatggctcactaacttcctgtatcaggcctggtcggtctgggacagcactactgcttgctggttttagattttttgttgctttgtgcaacttagtactgctgttgtcaggtgttgccttggggactctccagaaactctggtgaatatagacagctctctgagccttcaggctcccctgcagctcctggagggcaggtttcattgtaatgaggatgtttcgctatgaacagtagtcactctttctctaatcaggcccctggtgacaggccactacttgagggcacgttgtcccttgagctatatatgctgctcttgttacatggggtcttggtagtagtctggcctgtactgggtataagttgcaaagtcctggtctccagccagagtgagctggccagtatggtgaaactctatgtccatctctgccagggtccaacctggccgaatgacagatgaaaaatgcactctgagactgatatccagtgaaaaagcaggctaggggactgggcagctcacagacaccgaggagggagctgtaaagagtcagtagccacagccccgacaagctggcactgtgggcatttattcagtacagatttaatgacaaaggcctggagtcaacacgtcttgtgggtaattaacattgtcaccccccaccccccaagacagcagtcctgtgcacagatgattaaataccaggttccgaggcctaagtaaactaacttatctagatcaattcctttacacttccttgttatccattctgagaaaattcagctgccttcagccaaatcctcttctgaagctatgcaaatcccaggccttccaagaaggtttgcatccttttcctataatttatcttacaacttttcccaccatcctgaccgatctcctacacatctcactgatgagagagccacaggataccaggctcctgggtagcagcaattccctcatagtgaagtcagaaaagatgataaaatgctgggcttcagtgtgttgataaaggagagccaggatgaaaggatcaagtcacctaagcctaacctgtaatatggcaactgcacaagtccccttggcaattttcaagagcaagtgctgctgaggccagtgcctccttggttgctgcattccttcctgctatcactccttgtccccactagccactcagaggtcaagtggggcaccttcaaaagggaaacaactgcccacaaggccagtgcaaatggagctcacccccagatgtttttagtaacaatttgtaaagtcaaaacaacagggtgccaaacccaaggtcatctagattttctcctgttatcttctaggagttttataattttgtcttttacatttaggtctgtgatccattttgagtcctatttatctggtggaaacctgactgacatagcatatgcttctagtgtttaaaaaaaaaaaaaaaaacagaggaaagatgaagcattaactaatataaattagtagaaattgagtggaagaaatgaaaatagtctctctgtctactttatcatgccattttctttttgtgtttttgccatcagcatatacatctgttctctaatctactaactgaaaacataaaaaccttttgtaccacacgcgtcctcctgaactttacaacaaatttctctgctctccttgacagcaaactcaagggtcacttccagtttctttctctacttcctcatttcacattttctccagaactcattctaaatgggttcatgtcctgattactgcagtgggactactcttatcaaggacaacagtgacatccattgccatgttactgcactgcaggttcagacatttggtgcttgcctatgaatccaatggagtaaatctaagtcatatatgcttatctgataatgatgggaatcttaggcccctaagcatatatgactcagttgtccacacccttttattttaaaatatataattctcttggtgacatcacacttgtttggttttcttcctacctcagtgatttatctttctcaatctccttgactggctcttttctgacttttaaatgttggtgtacccgagggctcaattctagacccccctcatctatttgcatcaatgcagtcatcctaggtaatgtgttcctataacttgaaatcccatctgtacataaatgactccccctaaacatccatcataatccacaacttctcttcaggactccagactggtatctacctccctcctctgcatttccacttgaaaacctatggggcatcatcaaagtaaaactatcaatttgattccccctgaaacagttgcttgacaaatcttctacatttcttccaaatttaggaaaagtcatcacactctaccaaatgtcttaagtcccaaatataagtaattattgattctttattttatttatttattttttatgagatggagtctcactctgttgtccaggctggagtgctgtggtgcgatcttcactcaccgcaacctctgcctccaaggttcaagcaattatcctgcttcagcctcctaagtagttggggttacaaggttcatgccaccccgcctggctaatatttgtatttttagtagagatggggtttcaccatgttggccaggctggtctcaaactcctgatctcaagtgatccacctgccttggcctcccaaagtgcaaggattacaagcatgagccactgcacccggcctattgattcttttaatctaatccatcaccatatcccattgactctatgtcaaaaacgtggaccaaatctgtgtgtttctttcctgtccactaccacctgacttcaaaccatcatcatccggaccactacaatagtttcctaatctttctgcattcactcttgctctacagcaatcagttatttacacagcagccaaagttttttttttctaatataaacatgatcgtgcccatctcttgattaacaccctccaatagcttcccatcatgctaataataaaaacatctgaatccactatctgactcccaaagcctcatattatctggcttttgcctgtccttctgatggtcttcctcaacagtttttctttcatcgattatgttagtaattacactagtaatatctttatttctcaaacataccaaatcattcttgtctcagaatctttgtactaactgttgtcctgcttggaatattcttcctcttgaactttcatgtgaccagttcatgtaattctaatctcagtttaaacataacctcctcagaacatttttttctgagtccctaagataacgtagcctctcaggctctctccagtctagttcagcaaatattttagttcttttcatagcacttgttgtagctttttgtcaatcacaaaatcacctcccttctctcattctttgctggtctgagagcctttgacgcctctgtttttcttcatctattgtagcagcctccacattcatctgtcatttttcagtgagaaagagagtgggtatccagaaaatgaggtctgaaccatatacagcagagtttgttaagcctgaggtagacacctggtagccattaaaagatacagagcaatgtgatgatctgctctatttttttttaatttgtattgagtctaaagcttaaccataattttctttttttatttttattttttatttttttgagacaaggtcttactctgtttcccaggctagagtgcagtggtgcaatctcagctcactgcagcctctgccccctgggctcaagtgatcctcctgcctcagcctcccaagtagctgggactggaggtgcaaaccaccatgcctggctaatcaaccataaaaatttttcatttttatgaagtccaacttattccttttttacagattgtgcttttggtgtcatgtcaaagaattctttggttagctcttggtcctggacattttttaatgttttctcctaaaaatgtagtagttctacatttaatatttaaatctataatccatctttaattatcttttgcaaagaatgtgaggcttaggttgagtttcttttttgttaatatttttaatgtccaattacgccagtatcatttgttgaaaataatattctttcttcattgaattttttacgtatgtcaaaagtcaatattgtgtgtggatctatttccggactctattgtgttccattggtctgtctaccgtttagccaatatcacactgtcttgataattgtagcttaatagcaagtcttgacatactccaatgttgttccttttcaaaagtaatttggctattttagttcctttgcctttcgatataaatttttagaattaggttaatgtttttttaacttgaatcacattgaatctatggatttgcttgaagaagaactgatgtcttaatcatattctgtctgcagtactctcttattcagtactaatctttcaactctatctgccttgttcttcccaactcccaactttatcttcttatttcaaagagtctaccgggctctacctgtgtttcccctcctactctgtggcctgggaactctctcaagtcagtaatcaaggcaatcacgggaatcatcttatttgtttccccttttttggagattacaatgctatactacctgttgtccagtgtcagaaaaccattctttcccattttccctagatttttagttgtttaaggtaggagcataaatctggtctctcttatgccatcaccgctggaagtagttatgttgattgtgttttaaaaagtcattttttgcttctgttcatggagagagagagctgtttgcaaaagctagttcaggcatccagacaagagatggcatgagcctgtaggtgattcttggggtgcataaaatcagcagcacttggattttgcttaccaaatgagagaaaaatcaataataaattttagacttggcacttaatctactgagaggacaatgcctctgattcctaaaagaaagaaaactgaggaaggggcaggtcagggaataggagaactggggatactgttttcagaatgtttagtttgtcatgcctactgcttgtgttcacagaaattccaagaagttgactgattttatgaggctggaattttgggaagtggtcagggctgatggtttagattaacagttaggggtacaatatatttttttcttttagttttagttcacatcgtaattgtacatgtttaagggatacagagtgatatgttgatacatgcatacaatgtgtataatagtcaaatcagggtaattagcacatccatcacctaaaacatttatcatttctctatgtggtgaagattcaaaatcctctcctctagcttttcaaaaacacacaatagatttttttttttctagccacttatgtagctacaaaaatagtactggagtaggggcagggtcttgctctgtcacccaggctggagtgcagtggcacaatcatagctcactgcagccttaaaaccctgggctcaagtgatcctccacctcagtctctggagtagctgaggcatgtgcagccacactccttttatttatttatttgttttgtggaaacaaggtcacactatgttgcccaggcaaactcctggcctcaagatacagagaattaaaaagcacaatcaagtaacctaactgacatttataaaccatttcttacacctaagagtaggatatttcacataatacccaatataattcttttcaagtgctgggttataaaataagttttaataaaaatctaaggctttaaattatactaagtatattccatgaccataatctatcaaattaaaaaccagcaataacaacataactagcaaatgcccaaatctttggaaactaaacaacatatatgtaaataacccatgggccaaataaatcttaatgaagattagaaaatatttttaactgaaggataagaggagtacatttcaaattttgtgatttaaagctaaagacagtgtgcacacgatttttttttttaagacagggtcttgctctgtcactcaagctgcagtgaagtggcagaatcacggctcactgcagcttcaacctcttgggctcaagcaatcctcctgcctcagcctcctgaatggctgaggttataggcactcaccaccacatctggctaatttttaaatttttttgtagaggtggggtcttgctatgttgtccagactgctcttgaactcctggcctcaagcaatcatccaacctgagcctcccttacaggggaatttttaccttaagtgtttttattagagaataagtgtgtgaactcaatgatctaagtttacatttcaagaagctagaaaaatatcaaattaaatctaaagaaaatataagaaaataacttttaaaagtggaaataaatgaaatagagatcaatagaagaggaaatattaaagttatgttaagatatcaataaaatggataagtttctagcaatactaatcaagaaaaaagagaaaatacaaatgaccaatcttaggaatgaaaaaaggaacattattacagagactaaacacactaaaatgatattacaaatcactttataacattatatttgacaatttagatgaaatggacaaattccttgaaaagcacacatatgaaactgtcataaaaagaattagaaaatctaaatagtccaatacctagtaaagaaattgaatttctaatcaatacccattaaaaaaaaaaaaaacttcaggcttgcattgtttcacctgtgaattctactgaatatttaagaaagaagtaacatcagtcttacaagaaacacttccaaaagacagggaaaaaaggaacacttactagtttacttttaaatacatctgttcaatacaaaaattgtgcttgaagaataaagtgatttttatgaactgaagttaaaattaatattaataaattttttattttaaccaatatttcagaaaagttatgttttcactgacatggccagacataactgaaatcagtatctttttttttgagacagtcttgctctgttccccaggctggagtgcaatggcacgatctcggctcactgcaacctccgcctccctggttcaagcaattctcctgtctcagcctcctgagtagctcgaatcacagatgcctgccaccacgcccagctaatttttgtatttttagtagagatggggtttcaccatgttggtcaggctggtcttgaactactgacctcaggtgatccacctgccttggcctcccaaagtgctgggattacaggcgtgagccaccgcacccgaccttgaaatcaatatcttaagtaatgtttggatcatgcaattttaaagtgacacatactttacacattagtggttttaaaaagtttttctcacattgatgtcatggcaataaatggaagaaaaaaatacctagttcttgaaaacaataataaaaacctttgtttctaatgattactcatcatgtggaaatttgcagtgaaaccaaaatgaagccaagtaatttaatttctactcttcaaaaatctctgtatgtagtatttctggagtatctgactagtataataaggtttttttgcctttattgtcagacacttcattaaatcttaaggtggtaaaaacagtgtgaaatcatcataaaatcttaccattcaaataaatgtacttatgttttacactttttgaaatagatattctgacgggggtaagataatatctcattgtggttttgatttgcatttctctgacgatttgtgatgtttggcttttttaatgtacctgttggccatttctatgtcttcttctgaaaaacgtctattcatgtcctttgcttacgttttaatggaattaccagttctgttgttgtttccacacgaacattttcagatgaacattcattgagattttattcataaaagtcaaacctggaagtaactcagatgtctgtcaactggtgagtggatacactatagcatatctgtatgatggaatgttagagttaaaaaggaattgctaataaatgcaacaacattgtgaacaaaagttcctgaaaagggctgggtgcagtagctcacgcctgtaataccagcactttgggaggctgcggcgggtggatcacctgaggtcaggagttcaagaccagcataggcaacatggtgaaatccagtctctactaaaaatacaaaaattatacgggcatggtggcacgcacctgtaatcccagctacttgggaggcagaggcaggagaactgcttgaacccaggaggcagaggttgcagtgagcccagagggcgccactgcaccccagcctgggtgacagagtgagactctgtctcaaaaaaaaaaaaaaaagaaaagaaaagaaaaaattatctgaaaaggaatgtgaaggaaacagactttattccagcaaaaggctgcaaactacagaaacacaatctttgttgtaaaatgaaggtgtgttccagggaacagagggaaggctccggttttaaagcaaaagtttctgcccaggttccctatcacctatgttgctatcacctatgttgatgccaagaaagagtgaaacttacttagttcttattggttaacacagctcagtcctgattggttgatacagctgagcgctgattggccagggaaggtgaactctgattggttgcttcaggtgagctctgattggttggtttccaagccccaaaattaaaaggtgtgagttttgaggggacttagagtacctgtatgacctctagacagcaaatggctggtaggttctattttaaatttaagcccaagtaaccatacaggatccatcccaaaagactggctctttcaaattcacatttgttcacaacatgaatgcatctcaaaagcattatgctaagtgcacaaagtcagacacaaaaaactatctcttatataattccatatgtgtgacgttctagattacaaataactatagtaacagaaatgaggtgagtggctgtcagggaacaggaggtggggaaaggggatcaataattgcaaaggggcacaaaaaaactttggagtcaatataaatatctattttcagatgatggttacatgataatatttatagtccattttcatttataagtatagctacaaaaatcctaaataaaatattagcaaaccatatcccaaaatatatagaaaaatattgtactatgactaagttgcatttattacagaagtgcaaaggaactgatttatgccaaccacctgactgagcttggagccagcttcttcccccatcttcagataaaaacccagcccagatgacaccttggtttgattttgaccttgagatcctatgcagaacattcagccaaacgcattcagatgcctgacctacagagctatgagctaaaacatgagtgttgtttcacactgctaaatttgtagtcatttctacatagcaacagagaacaaatacaaatattataatactatttataaaacttaaaaatctaaatattgagttctttaggtatccacatataagtgcatatttctaaaaatcaaggaaatcacatacacaattctagatggaaatttttagcggggtgggagtattggaatgattaggcaaatacacgattgatgcaaagatgggacagaaatgaaagactgtcattagcatattatcaaacattacctttattaagcaaaaaaagccaatggttaaatatgcatttaaatgtttaattagaaactaaattattcgttgtgcacatgtaccctagaacttaaagtataataaaaaatttttttttaaaatagccattctccctggtataagagggttaaaaaaagaaactaaatttttatatttattatataattatataaatatttatatataagtataaacataaatatatataaatttatattaaattaaatagaatttaattttaaatttaatttaaaagtttaaatatgcgtttaacctgatctgctttatgtatttaagaaaatgaaatatccatactatgcagttcaatttaataacatagtacaaaagataagtttggtatagatggtaaattgtagatgcttttactattactgcctggttttttatttacaagcatgtaacaatttttgtaataaataattgttgtaaggagatctttatttaaaatcctcagaagttttcaaatatgtactcaaagataaattcatataggaaaacgaactatatgaaagcagaaaaggaaaagttaattagataattaaaattgccacagaaaggtatatatttgaataataataaaagaacatttctcaattatctactataaaccaggcactttgctagcatttcaggcacaccattccaataatcttcaaaagaaatttgcaaaggagataccatcattttttcctaacagtaaaacttacagcatttcaataccttgcccaaagtcatgcagacagtaaatagcaaaatcggcataaagaatcaggactaaaatgttatttcaaaggattcatcaagaaataaattatgttagccaggcgtggttgagcatgcctttagtcctagttactcagcaggccgagacaggaggatcacttgagcccaggaggttgaggctgcagtaagctatgatcacccctctgcactccagcctgggtgacagagcaagactctttctctaatgattaaacataataataataagaagaaattacacacacatacccatacacatataccaagtatttatgacacaattttaataattgctgaatctaggtgatgggtacacaggtgaccaccatgttgctattccttcagtgtacttgaaaggtttcagtatgaaatgttgggaaatatggttgggtacttagtacagcacccaaatccctggcatctgaagcaatgaagtacctccttccccagcccttcccatcaccgatagccataatggcccccaactccgcatcgcttgctcgcttttcctggttccccagacaccgacttccactcgacgctgaggatgctccaatccagaccacagaagccctcagtggctaacccccagcttcagattccactgaccattccctgaagccttcttacaccgcaaacctccacaagtaccccatgctggtcgcatccggtcaaggaccccaacagcgctgggaaactcaccctacagctggagtcgcacaaacattcgcttgaggactagcaggtttccgtaacctcttcactcactgccgtagtcacgctcttgtgcagactcagtagcaccttcgcggaacacaagatgtctacagactttgaaaccaggcgtgcacatggaagcagcagtcttggaagatgcttcttacagatagcgagatggccattttctggcgactaaattccatcgtgctagaaaggaaagaggcaatgcagctgatcttctactgtccttttcaccacttccccagctgctaccagcagcgttgtgcattctcaggaacaacattcagcgttctcacctgtctacttcaaatctagcaacagccctaagccaatcacagacaagacctaagcagaagatggctgcacctatttagccccataggcccttaaagcagcaggtaaggcgcagccatatttgaaaaagttttgggatctgttgatcaaagactaggcagtggagcaaggaagtgggagcaggcagagggtggattctgggaatgtgtttgtcgagagaagtcttaggaaaccagaattgggtctggaggagctcaggtagtaagggggaagccacctgggtacatttgggtgtgggattgtggagagagaccttgaggggtaagaactgggccaaactggttgtggagcagacactgacaaccacaacccattccaagagaatattagttgtacttcagaaagatcatgtgtattctgaacagtcatgtgaaatagatgtaaaagtcatgaagaaattattagcaatcaaatctagcattatatgaaaagaatgaacttcaagatcaggttcccaggaatacaaggatgttttatcccttaaaaataaatacatgtaatgtatggtgccagccatgattaagtaagccccctagtttatcactcccactggttagagttaaaacttttgaaaaaaaactaataaaaactacttgagaacttttaaaatgaataattgcaaagagattggagaataaagtatagagttgaaaaccaagcaatgcacagagtaagttccctcattttttttctgtctatatctcctgcctttgacctaagggtaagacaaattaggaaattgttagtccaaactgcaccattttggaagccccccaccatttcacaaaacctgatcaaagtgaaacattccacagggggttcgggctgtgagaaacatcctgcctcttatcatattctgctgggagaaagtgcaaggaacaccactttccgcgggaatcgcctcatcctgggaacatgtccccccaggcccctctcacccaggcctataaattgccccagcctataagcggtgggcactggcattaggctgtttcctcacttctgcaggtcttatgctggacataaagcctgcatttgctgtagagccaccactccatgtctttctttaacccttgccttcccttcaaaacctaacagaaatttcgctgctgaggtgaagagcaaggacactaagaaaaaccagccttcatggccagaaaacagagaaaatgaatccacatgagccaaaaagtgtgttgtggggatctctattttattttattttttccgtttttctagtttttctagcatggtcttgctagttctactgttgaaactgcactgccacagtactggcagtgacatggacacctaaaactcaagaaaaaaaatctatagatagaaaatattaggcccgatgcggtggctcatgcctgtaatctcagcactttggggggccaaggcgggtggatcacctggggtcaggagtttgaggccaggctggccaacatggtgaaacctcatctgtactaaaaatacaaaaattagccaggcatggtggcaggcacctgtaatcccacctacttgggaggctgaggcaggagaatcagttgaatctttctgatgccaatcataagcttgccacattagttctagagaataacaaacaaaaaacaatgaattctaccattatcatgaaatggagagggatggaatctcaagttcatatacaagaaaaattcagaaagtgatctgcagatacacagtgtaagtctgagacattcaataaaagaaatatataataggcttgaaggacacaggtgtcatcaaacttggaaaagattctaggaatatttgaaagcatactagaagaggtctataaatattggtaggaggtgaagggtggttgtatctaataggctgcaaaagaaaagtgactaagcaaaaaggcaagggccaaataggcaagaatctcaaccagagggagaaagagaggcacatctcctatgagtcatacatagaaatatagtgctatggtctgatgtgtcccccaaaactcatctgctagaaagttaatcctcagtgcagcagtgacagggaagtggggcctaatgggaggtgtctaggtcatgagggctccacctcatgagcaagttaatgccatgataaaaaggccttgtgggagtgggtttgctactttttgctctcctgccatatgagaacccaacattcatccttacttgccgttctattatctgccatgtgaggatgctgcaaaaaggccctcagcagataccagatactggtaccctgatcttggacttcccagcctgcagaactgtgagaaataaatttcaattatttataaattaccctgtctcaagtattttgttatagcagcacaagtggactatgacagatagtaagaggaggagaaattgttcatattgaagacctcttttcacttatactctaagtcacccttaaaggttcacagaccatgagaaaatgtattaaaataacaagggtgccaacccatcaatggccaactagtactttggttccactaactcccatcgcattggtttcactcacctggactgcaccaacttgggaattctctctctactattccttgttcttctttccccaactggaatattgcttctggcttggtagcttgacaacctgtcaagaggtaatcacagagaatctgagcagcattagagcttgtgagaaaaagttctgtttcaggaaatgcacagtatacatctcagcagaacagaaacctttcatttggaaagtgaaattacatatggtcactgtacgattataaagtaaaaaaagttctaaaagtcaaagtccaaaatcattgaggatatcagagtacccacaaattgtggcaatagaaaaaaaggcaattaatcggcttacagtgagatatttaggaaagttgtctttacccagtgacactaggttgttgtaattttccaacatcacatcctggtagaggttcttctgaacagggtctaatagattccactcctcccaggtgaagtcaacagccacatcattgaatgatgataaaccctataataacataatccttttaaattctggagttaatataataaaattcagtctataagactcgtaggacattattctctttatctttaccacaaagattcacaaacgaagattttcctgtgcctagttttggtttgcactttgtgagtggaatacattaaaaactatcttttctttgtgcattcttcattcacttgtttactctttcattcatttgcccgatgtaaagtgtcttttaaacctttaaactacctaaaaaccatctgtaacccaccttaggagcatttaatgtaattcattatacatattacaataaaaacaataaaggttagtccttccttcaagtgtttctgatcttgcacagagtagcaaatacagtcctatgcagaaagcctatgtattgcatggtattatggattagcaaggactaagacagaagtatgctcaagctaatatgtgagcacaattaggtaaggccataattgttctgaagaggtagacaagctggtagcatgattagtagtgcgttctaaaggaagaagtggaagaaatgggggcttccttggaagggggcaacatatgtatctgtattaaataccattctgcgttcaaagaaatgcaaatagttcattaagacaggagaagctgaagagaagaaatgcccatttgaaaagcaggaacatgtcttggagcaaagggtacacatttccttaagatactcgatagccactacacttttttttttttttttttttttacataagtaagttacggtcagaattgcattttggaaattgtgctacaaattaaatgatgatactcataaagaaaaacagacttcttactatgtgctatgtatcattctacaaattttacatatattaacataataatctgcacaataacccttgtttaagcactattatgttctttttataaagaagagattttaagtttcctagctgtgccttttatatctcccacatttccttaaagattactgttcactgggtccatatgctggcacacaaaaactgaagaggaagaggaagatccatcagagacatttcttcacactggatgcccaggaaatatttactgatatcaacgattttatgtgctttctccttctggacaaagtaaatcttgtaacttttaaaaattctcttgtgatggttgtcagtactgccacaaaaatgtttgcaacttaattctagatcctgctacttatatggcaattgtctaattattagcacctttcaggaccctacgacatggagatagatctcccttcctaactggctactcttgatcatttattctgtctcctagtctaaccacatccctgccagccagagtgtacttatattcatttttctctttgattacatatatggttataaacttctaaaaatctactgggaagtaaataaacacctcacttggaactttgtcatgttcaagagctttcagaagatggccagtacttttagtatctgtttgtcctgcaattctgataatgtctcatcaagggtatcctcaacaaagatgaatttctggacatgagatatacttttttcctttacaggagctgcctcattctaagaagtcagcatctatgaattcaaacaaaaatgtgttttaaagtagaaataataaagagcaagtccgcgtaaataaaaagacttttctttttaaaattaattcatttcctatacctaacaaataaaattgtatgtatttatcagtacaatacgttgttttgaaataagtatatactgtggaatggctaaatcaaactaattaacatatgtattacttcacatacttgccatatttttgtggtgtgaacacttgaaatctattctcttaagcaattttcaagagtacaatacttggccgggcacggtggctcacacctgtaatcccagcactttgggaggcagaggcaggcggatcacctgaggtcggagtttgagaccagcctgatcaacatggagaaacccggtcactactaaaaataccaaattatccgtggtggtgtatgcctgtaatcccagctacccgggaggctgaggcaggagaatcgcttgaacccgggaggtggaggttatggtcagcgaagattgcaccattgcactccaacctgggcaacaagagcaaaactctgcctcaaaaaaaaaaagaaaagaaataatacaataccttgttatttactacagtcaccatgttgtacaatagatctcttaaacataaaagttcatgtcttatctaactgaaattttttattctttcaccaacatttccacaaccctctccctcccccagccttggtaaccaccattctactctccatttctatgaattcaataattttagatttcacacataagtgagatcatgcaatatttgtctttctctgtgaggcttatttcacttaacataatgtattccaagttcatctatgttgtcaccaagtgacaggatttccttcttttttgtggctcaagagtattccattgtgtatatatgccacgttttcttcattcattgttgttggacacctaggttgattacctctcttggctattgtgaataacactgcaatgaacatgggagtgcagctatatctgcaaagtgctgatttcatttcctttcgatatgtgcccagtagtaggattgctgcattatatggtggttctatttttttttttttgagacagagtcttgctctgttgtccaggctggagtgcagtggcactgtcatggctgactgcagccccaacctcccaagctcaagcaatcctcccacctcagcctcctgagtagttgggactacatgtgtgtccagctaattagtccaccatgcccagctaattttttatttctaaaaacaaataaatttttatttgagaccagcctgtataacacagtgagttcttgtctctataagaaataaaaggtatacatttgcataataatagctaccttttgtcaagtatctattaatacgtatttgcagatgagtcactggaaggtaactagggttagatgaggtcatgagggtgggccttcaatatggaattagtgaccttaaaagaagagatattggctgggtgccatggctaatacctgtaatgccaactctttgggaggccgaggccggtggatcacttgaggccaggagtttgagaccagcctggccaatatagcaaaaccgtgtctctactaaaaatacagaaaattagccaggtgtggtgcaaacgcctgtaatcactgctacttgggaggctaaggaatgagaatcacttgaacccgggaggcagaggttgcagtgagccgagatcgcgccactgcactccagcctgggccacagagcgagactccatctcaaaaaaaaaacaagaagagaatttgcattctccccctactgccatatgaaaacagatggccatctgcaaaccagaaaaagatctctcaccaaaactcatcccacactggcactgtgatcacggacttccagcttccagaactataagaaaacaagtttctcttgtttaagccactcagtctatggtattttgttatggcagcccaagctgactaatacattacatgccagcactttgtcagggacttcaaatgcactacctcactcaatcctcaaaacccatctgcaaggtagatattttcaatttgtcataatggaaaaactgagacttacagaagttgggtatcttgcccaaagtcacacaaaatagggtagaattgacataaaaagctagtactaatttcaagtgtatacaaacactcgtgtacgcacacacatgcacacacatagcatttatgacacgattttgacaactcatgaattttggttgtacaggttatcatattgctattctttcgagttttctatatacttgaaattcttcgacataagatattgggaaatataatacctcaatgtaaaatacagcacccaaatgtctgtacagctgaggcctccttatgttccagccccaccagcctctcccgtcgatgtccgtgttgctctccacccaagcatcttgctgttgcctcactcacacctccccagacacctactttcaagtggagcataaaacggaccctccaaatactcaaacttggacccctgaaacctcagatcactaaccgccaatccctgtcctcgccgaccacatcctgacggccccctccatcggtggctctcccaggcctctctctctgtggcagggagcacgatgaggagaggatatttcacgagaaacgagagaatggtctctagtttcttcctcaatccacagctctaaacactgatgccggccctaaaagccctcaacaaccccgaagcggccttaaacggcaaccccagatggtactcatcagaaaccaatcccaagtcacggaattcccacagcgctgcgggattcctaagggctttaggcagagtcaaatgtaatctcacacaggagtcccgtgaatttactccctggaaggcaaagcttccatacgtcatttcctcttctgctcactgggctggatggccaggctttccagctattatacaaactcagtagcactttggaaggccaggatccatctacagacgcggatcccggtcccaccaggaatgatcgctcagcaatatggtcgcgcccaagccctgacatgctgttggaagccaccatcttggaagacgcagtacagactgcgagacagccattctaggcgaccggattccgctgaccaggccgaaaaggagtaaatctaactgatcctttctaatcttctaaagacctctcatcctgtacttccaccttctttcctgtcagcgtagggcatgcttagtaggatttcggcactttcaactagtcttccgacctgaccaatcagaacacaccgaaacagaaaatggctgcgcccacgctgcctcgttcttctaaaccacacgaaaggtgaggccgtattgaaaagcctgggtccctaggggaaagaagggagggagaattaggaagcttgtacagctaagacgcggaagacgctgggaatatacccaaaggaaatgaaatcactatgtggaagaggtatctgtactcccacatttactgaagcattattcacaatacccaagatatggaatctttctccatacgactgagaaagatggagattaggagacctagaactggatctggacgaacagaggtggtatgggaagagctctctggatgtgtggtttgtggggagagatggtgagggcttaagaactaatgtaaagatgcctgtggagcagacacgggcaaccacaatccaggccacaagaaaagcatttgtagctcacagggatcctgtgtatcttgaagagcacaacccacccagacatttgtcaatactgtgatgcaggagtcaacttccttttttccctggctagataattatcccaacaacattatttaaagttgatctcttccccaatttgctaatattttgtaaggagttgtacatctaagttcatgggatatttggtctgtaattatcttttattttaataatgcctctgtctagttttggtgtcaagattatattgcctttagataatgagctggaaaaaaatcatctttttgatgtatgtagttctaaaccatttttttgttttaatattccattgtatgaatctgttttctgcactgacacattcaacacaattgccaagctgttacccccttttaaaatatgtgcacattttctgtctcttttattatataaaaacttgaactatttccacagtttggggaaggaaactatacacaggtctttctgtgtcattacctactcttctccaatggagaaagggtaagtttaacaaaataggttgcgcatacaaaacaggttgtgcatggatggtttataacacttcctttttctatgttctttgtgtttgggttaacctgtctgcaggatgaagatttgctcttcagaatacatttgctatgttctgaatgtgtcccctaaaattcatgtgttgagaccttaattcccagtgcaatggtgttgggaagtgaggcttaatggaaggcgtttcgttcatgagaattctactttcataccacttgtaaaaggacttacaggagtaggttcacccccttctgccttttgccatgtgaggacacagcaagaaatcttcaccagatgtcagcaccttgatcttagactccctgcccactacagaactgtgagcaactacatttctgttcttcataaattatccagtctcaagcattttgttatagcagtacaaataaagacaacgctgttaaggaaacgatactggaaccctcatacactgttagtaacattcaaaaatggtaccacttcttcgaaaaagtttggccactttttatgttaaacaagcaatctaactattaagcatttacccaaaagaaatgagaagttattcaaaatagtgaaaaacccagatgcctatcaactggtgcagataaacctattccagtttacttatacaatggaatactattcgtcaacaaaagaacaaactactgacatatacagcaacatgaatgaagttccattttattatgctaagtgtaaaaaggtagactcaaaatgttatgtgctgtatcattcttttaataacactatggaaaagacaaaattagacagagaactgatttgttctctgttctggggatggggagagaagggttgactaaaatggacagaaggagggatttttgggcggtggtggaacttatgaagtaaagcactaatcttctccaaagagaggtttggcccttgctctcaactcctgggagatgacctctaagcctctgaaatttcctgcttgggaagagtatctttgtttacctggttgccttgggccatgccagatatgctaacaatatgttttatgatgggggcccttaggccatgcggtatgaactccacctgtgcagactatggtcacccatgtggatagtcaatcacgtctatgtgattgaacccaagtaaaatatctggacaccaaggtttgggcaaacttcccttattggcattattctgcatattgtcgcaaattgtttctgaaagaaataggtgctgcctgcatgatttctctgaaagaagacaactgggagctctgtgcttggtgtccactggaccctaccctatgcagttcatccctctactgactttgttctgtagcctcctgctgtaatatactgtacctgtgggtataatgccttttctgagtcttgtgagtaaattattaaacctgagggtagtgtttaaactttgaagttggtgtcagaaatgagagtaatcatgggtatccccaaatttacagttggtattattataaaaagtgatattggggaacactgaacttgcagctggtgtcagaagtgaagatggtcttggggactcccaaattacaaaactgttttgcaccataatcatggtggtaacatgattctatttgtcaaaagtcatagaactgtagaccaaatcagtgagcattaccatatgtaaactagtaaacaaataaaaaatttaaagatacaaaacattgtgtatagtacggtgtagttagtaagttgaaggtgatttttacttttgtttaggataagcatataattttgtgataaaaataagagatcaccatttaaaattatggaaagttctcaaatctatactcaaattcatataagatttaggatatacatttagaagaaagttaaatcagaaatggcataattacaatctttataaggtatcagaaatgaggataaatatttgaaaaatagctaccattggtcaaataccaattataagccagtcattttgccaggcatttcagataccccatcttattacttcttcaaaacaaacttgacaagtagatatcatttttcttttcctaatggaaaagctgaaacttgtaagagtctgtgtaccttgccaaagttcacacagccaatgagtagcagaaatagattaaaaattaatcttactttcaaatagctcagtaggaaaaaaagtacagatacacacatacaaatatacattaagtatttataaaacagtgtaaataattgttgaatatgtaagtggtgggttactattctttcaactttcccatacgttgaaaattcatattgcacccaaacttctctcctgagtcctaactactaagctcatcagccatctcctagcactgacacccataatgcccccatatccccacacctcacatttgctcctgttcacaactccccagacaccttatttcacacagaccctaacacagactcttcaactcctcaaacccaaaatacagacagaagccccagatgaccaagccagcagcctatgctctcaaagaccattccctgaaagctagtgggtctcccaatgccaagatctggagccgccctgtcactgccccaggaaacaacccttacgtctgtcattccttttccacccacaaggtattcttgtaaacacaatgatgtctttaggacattcgccccagacactttagaagctgcctttaaccaaccccaatgaataccctcacgcatcacctgccacatccccaagtcacgaatccctacagtggcgcattccagcagttcacagaaactgaaactttgccttaacttctacagtgacctgctgccatgaaagtataaggcttcctacactgcacatccgcttccacccactggcctggctgtcctgcctctagggctattgcgcagactcagtagaaactggaacgaccaggagtcccagattctgatgtctaaagcctttagcttcctgctctttggaaagctcatttcaatcaagtctgcaggaggtagccatcttgaaagaagtgccaccagacagcgtgctggccattcttttgggctaatgggctgcctctgagaggaaagaaacaattgcaacccaccttttctgtccttttccaagacacgtcagcacgagcatttacacctgtccaaaagttgcaaggagtgtggctcatgctcaatagcatttccgtgatcccacctatctgtcatgaacctccagacagcgaaaaccaatcaccaggtcaaacctaaactgaagatgtctttttgccctgttgaaatcttgtccattttggaggaattttgaggtttatagagcaaagaatacattccctcaccgaggaagaagggaacagacagggcagattctaggtctacctctaacagaggtaagctagagaagtgaaactggctgagggaaagtgctcctggctttctctgtgtagagatcttgcccatagaaggtgataggtgggatgtttatgaggaatggataaataggacttctggaatgctccattgcttgatctgagtggtattacacagttgtccacatataggtgttcccatcacatgttaaaatgtcatgtgtgtgtaattgtgtttaatatacttttgtaatgatatgaatgttttaataattgtatatgccctgtctttacatggctagctgtcaggtagggtgaatggctctttaaaagacagttttcttttctttttttttttctttgagacagggtttcactcccattgcccaggctggagtgcagtggcacaatcttggctcactgcaacctccgcctctgccttcgggctcaagcaattctcccgcctcagcctccagagtagcagggatgacaggcacaggccgccccacccagctaatttttgtattttctgtaaagacaaggtttcaccatgttgcccagactggtctcgaactcctgagctcaaatgatctgcctgttttggcttcccaaagtgctgggattacaggcatgagccaggtgatgggccctgaccccaaagacagttttcttacttcctactccttactccctttctctaactcaacaccactgggtcttcagtggtcagctcagcaattacagatacttcttagaacccactatctcaaacttcccaatagggacaacaagttttggccagcctcaagtaaaaagtgagccaggagccagtaatctcatgcaaaaagggcactaccctaagatttaacattttttctctttctcttttacctgctggatcttgggtgaactgcgttgtattggtctttttacagatgcattagaggattttggtcaattggaccaatctagaggataacggctgttcagcttcaagaacaggtaactgtacgggagtctatgtagtagagcctggttctgaacctggccatatgatctttaaagataatgaaggctctgttgctaccttctatagtatccccagatttgtgagcttcttggcttccttgaaactttcattgaaaataagtttctctttttcagcttgctagtcttcagtgtgtaagcccccttctttcttaaataccacacccctaaaggattgacatcgtgaaggtgttgtgctttgtaggacaatacattattataagctccaagttgaggtatttgggagtgaagggttatgatgtctgctatttaccttcaaatagttcagtcgaaagaagcaaactggatagaagagcgagatagattataggtagaagataaagcaaatatggcaaaaattaacatttattgaatctatgtgatgtatgtaagggtctctgctatactattctttaagtttttctatatgtctgaaaatttttataataaaaaccttgagaaaaactaccagtgactgattctggattgtatgtaattgattctttggttgcttgttttctgtgtagcagaaaatccacgaataaagtagaggttctgtctatcatatatcattggcataaatatcctcagtgctcatctgataataaccattctgcacccatctgggaaggaccaggtttctgtttagtttaccaggatgaaagcctgtggagaaggtaatgaattgatgctatttggattttttttttttgagacaggatctcactcttgtcactgcagatggggtgcagtgccacgatcatggctcactgcagccttgacctcctgagctcaggcaatcctcctgcctctgcctcctgagtagctgggactacaggaatgcaccaccatgcccagctaaattttttttttttttttttttagagatggggtctcgctatgttgcccatgcttctcctgaactcctggactcaagcaatcctccaatctcagcttcccaaagtactgggtttacaagtgagagccactgtgcccagcctatttggaatttattgaccttctcagatggacggaataattttcatcaaatttgggaagctttggccattatttcttcaaatattctatctgttgcttatcccctctatttactttctgagactttcattacatatgtgttggtgtgctggaaagtataccatatgtttctaagagtctgttcactttatgtttttcactttttttctgtttcacttcttcatgttcctcagactggataatttccattgacctagcttcatatttgcttattctgtcttctgccacctcaaatctgctgctgagacctgttctctttgttgctacttcatagttctttatacatggtttacttcagttccttgaacatagttaacatagctgacttttaatctttgcatattaagtctgacatatgagcctcctcaggggtagtttcagttgacaacctcatttcctgaatatggactatacttttctgattgtgtgtcacaaatttttgttgaatatagaaattttagatcatataaagttgttactttggaaatcagattccctctctccccagggtttattgttgcgattgttgttgcagtttgttcagtggcattcctggagtaatttatgtattccctgcagtgtgcagtcacttgaagtcttttcttagttagctaatgattaatcaagatttccttcatttctctgagcaagttttccactctttgctgagggtgctgtgtgtgtgtgtgtgtgtgtgtgtgtgtgtgtgtgtgtgtctacttcaatgctcaagcagtttgtaagtctactttagccttctcttccttcttctcaagggcttcaagatcagctagaagtgaactactggtaccctcaggtatctcatgggcatgcacacatccctgtgtatgtgttgggccttctagatcctcaggaatatgtcagagtatttaagagttccctattaacatcttgttcttcagatgtccgtttaacaatttttcagagctcttgtttgctccctaacggtactgcaggcttaggctactacaaagttaaacaattgaagctgatcgtttttgaccagtgccctagtatcgcacttttccttcaaagtgagctttgagtcaggtgagagaatgagttaggacaaagaatggaaccacatcatggagctgtaagacaagatatataatgacattgctctgaggatgaggctttttgaggatttccaagcttatttgtctcctctgatacaagggtggtggttgaaggctgatggtcttcatggctactgtggttctgaggctgctgttttccaacggtaatgcagatctggggaaagggatatagaagtaggccaaattaaaattccacataccccactatttttaatgaggttcaaaatttttttcttgaaaagaaaatgctgttcaaaatattgtaagcctttggttattttccaaaattgactgtgatgatgtttatgttgttttaatgaaaggatggatacgcagaggccttgtctctgctattctggacatcatgccttatcacataatttattttttgcacagtaatctctgggataaaaatttattaactttacaagtaaataccctaagtcttctaatgattaaatggtttaccatgggttatacagttgatacacaaagccattactgtttatcaatatataatactgcaccaatttaataattgtgctaatgaactgttaaaaattcgaatatgtccccagattatttctacccaacctcacctccatgcttccatcaagtatctcaaagaaaaaatacagagaacatcaggataatgctaacagacagttttgtgtttatttggttgtatgcctgccttctgagtaaagagtaaagcctctacatcgctaagtcaatgtcatacaaatcctttaattatccgtattttgggtgtatgtctgtcatattctagacatccacatacccttgctttcttaagtgaataaccagattctctgaagaagagacactgttgtgaacaggaccatcagtaattttggattttttttcaccatttaagacgagaaacttggtgctcggggaccttgaacatcaagatcggggggctgagggagggataatatactgcatgaaaggtggtagtatattgcagccagaggcttgattggaaaagaacagcattatgaatgagcaggatagaactgataaagtaaaacgaaatgaaagtacttcctagaagcagcatgatttgaatggcttttgcctcaggggagaatctgtaggagctgctgagggtgtgaatgcgcctcactctaccatgtagacaccagctccaaccatgagtccatgaagacaacatctgggaaagtcaagagaaatgtgtattttgtgtaatctcagcactttgggaggccgaggcaggcggaacatgaggtcaagagatcgagactatcctggccaacatggtgaaaccccatctctactaaaaatacaaaaattatctgggtgtgatggcgcacgcctgtagtcccagctgttcaggaggctgaggcaggagaatcgcttgaacccgggaggcggaggctgcagtgaaccgatatcgtgccaccgcatttcagcctggcgacaaagcgagactccatcaaaaaagaaaagaaaggaaggaaaagaaaaggagaaaggagagaaagaaagagagaaagaaagaaggaaggaaagaaagaaagaaagaaagaaagaaagaaagaaagaaagaaagaaagaaagaaagaaagaaaagaaaaaacaaagaaaggaaggagaagaaatgtgtattttgcagtagatgtttcaggatttttagaagagcatagaccacaatttcatatcttggtagaattggggatatgccgaagggcctctacatgtttaagaacaaagatttttattgtaggttgaagaaccaatacagaaagcaggagaaaccgatgttcttcaaagctctgtctttgaacctcatccacccaccagccttcgggtgggtgattgcctgagaactgctcaagtggcaagtgactgtagctttcaggctgctcaccagaaatatacagatacatatatatctgtacacatacacacacacacacgcacacacacaaaactctaagaacctattatctcatgtgctgctttcaaatctaagattattattttaaaattttttgtagagatggagtctcgttacgttgcccaggctggtctcaaactcctgggctcaagggatcctccaaaggatccacctgtaatcccaaagtgctgggattacaggtgcgggccattgtgtctggcctgcttttagtctttgagctttacagggccctgaaggcctatctttgaattcccttactctcaccagatatgctcccactgcacaggaaaggctcccacccagctaactccccaatcagctgaactagctgcacccaacatggtcctcaatctatattcagcccatggaattatacaaagcaattgcattcttccacagaaaccatgggcacgttaccctctcattatataaagcctacttcccacaatctccgtgcttgttcactctattcctgagtgcaatacctatatgcaatgaccatttctctcaggctgtatctgtgactaataaactgctgtcaatttcatctagccagtgtcaggtgttgtgttcagccattccatactacttagggtagggagtccctccctcatgcaccagggtgaataggaggttgtcagaacatatgacacacacaaacacacacagaaaaatgttgcaatggtcaaatccagattagtgtttagtactccttaaacatctttatgtctgaagattttcataataaaatggtgaagaaaagatttcttgacaactgtcaaacaaaatggggaaggggcaaaaatctagagaaaaaaataagcaagattttgctggtacatttttacagaattccttgcaaaacaataggtttcactgataaccaaaataagtcagttatttcacatggaggtaaaaaaaaaccttgctttttaataactagaatacccactagaagttttatagaagattcagtcaagtaagtctcattttgttaaaaaaaagtccatatttgaagtgccagagttcatgcaatatttttctttttaaatatatttttcttcatgtaaaaattcaaatattaacaattttagagtgtacaattcagtgaagtttagcacattcacaatattatgcaaccaccatctctatctagttcaaaaacattttcatcattctaaaagaaaaccccatacatactacgcagatagattgcattctcccttcccctctagtgcccaataaccactaatttgctttatttctctatagatttacctattcagagtatttgatataaatgaaagtataaaatgtggaatttgcatttggcttctttcactcagtatgttttttggggctcattcatgcaacatgtcatcagtacttcattcatttgtataactgaccatttatgtattcatgtgtacatgcatgtagcacattttatttattcatcctttgataggcatttgagttttttcaaccaaatgctattttggctattgtgaacagtgctataaacattcatggacaaatatttggttgagtacctgttttcaattctcatgggtattttacttaggaatggaattcctgggtcatatggtaagtctggatttaactttttgaggaaccaccaaaggaatggcatattatcataacaaatcaaaagtttcggtgtgacacaaacttgaaatatatagccataaactcacctcatataacctcacacttttttcttccattactctaatgtgttgctggtttttaaatattttaggtaaatcttttataatctttggatgtttcagagttataaggctctagaaaaatgtaaacttctacttgtgatggatcatcacagtgggcaaaaatactacaaatgacagcaaaaataaggaattcacacttacgtggtataatcctttagactccttaataatgagtcaaatatgtattacaagacattttgattcataagaaaaaaacattttatttgcactacattgaattattcaacattttgtcttatgttgagaatttctttaaccctgaaaattgtttcttcgtgtaattccaagtaaacaatgaagtttataaatatataaagtacatgtcacatagtacagtccacaacacaacccctaagatcctttgtcactattcgactaatccttattatattcttatttttcatatattcaaaaggaatatttgacaatgaaatgtctaatatttatagaatattctctggaatcctttctataataattatgcaaaaccattataaaattatatatacaggcaagggtaattactcaaatctaaagtgccatcacacatttaaaaagccctgacaattactatgacattccagatcataagatgcttcacaatttaagacatggtaggatgtgaagaagtgaatccatgaaataaaaaataacttatcactgatgcttttaccactttcactgcattcataaaatctctgtatggagcaaattctgctcctatatttaaaagcttgtgatgtttaatgctatctaatcctccacagaaattatttcctgtgaccagaaccattgcttttaggtaaatgtatgactctgctgaagcagaatagatatggctccattaggattttatacctgcattgaacctaaatattattgccttcgagaataggatctttctgataactgagttagggggcaattcagctctgaattttaaataaagaattttagacaatcactgcaattctttcctgctatgcaatgggttttgtggccaatggccaagtttaactctatcgttttcccttctgatttaagtatctgatgtatatgtcactttcaaaagctttccacattccgtttcagaaggacctatctaccacatgagtttgctgatataattagtgacctttggtatctacatgaaggctttaccacatttactatattaataggggtttcctcttgtatgagtttgctataacaagaaagataaacattaactgggaagactttatcacaatcacattcactgtatctatgagatttctctcgtaaacaagatattcaaagagttttgactttcagattttaatttttacctgcaatgaggtgtgattcttcttagctttcctgcattccctccatctgtagggtccttctcctgaatgaataccctaatgtgtaacaaatataatttgagaatgatttatcattttcattacatccactggtgctgcctactaaatggaaagcttctagttttctaataaacttttttgacaatcactgcactcataattgactctctctttttttttttttttttttttttgagacagagtctcactctgtcacccaggctggagtacactggtgcaatctcggcttactgcaacctccacctcctaggttcaagagattctcctgcctcagcctcctgagtagttaggattacaggtgtgcacaccacacctggctatttgtttttttttttttttgtatttttagtagagacagggtttcatcatgttggccaggctggtctcgaactcccaacctcaagtgatctgcctgcttcagcctcccaaagtgctgagataacaggcatgggccaatgcgcctggccaatgattcttcttgtgagatctctacggtaaacgagggatatcttcaaaaaagaaggcttaaaatattcattgcatctataaggtttctctcccacaagagttccaaaagggcccattacaatcatagtattcatggaacttctattgtgtctgagctgatgtgactaatcaaaaaagctctctcatattccaagtcactgcatggactttcttccttcctgctggggtttctgatgattagtaatagctgatttctgagtaaagctttttgacattcactgcatctatagggcctctttcctgtgtgagttctctggtgaccaatgagagtttacaaagtagcgaatgctttcttacaatcactgcatttatatggtttctctcctgtatgaattctctaatgtacagtgagacaggatttaactatgatggctttattacacatgctacatttgaggagtttctcacctgtataggttctctgttatataatgagagttgacttacaggacaaaaccttcccacatccactgtatccataagatttcattcttgcatggcaagtttttcgatgcttactgagacctgtcttttgggtgaaagcttgttgaccttcattgcatcatagggtctctctcctgtgtgaattggctgatgagtcatgagatataccttactggagaaggccctatcacagtctgagcattcatatgatttatttcctatatgagttctctgatatacaatgagatttccctttgatgtgaaggctttatcacatacattgcatttgaagggtttctcacctgtatgggttctctgatgtataacaaagttttttttggaggataaaaccttcccacattcactgcattcatgggatttccttactgcatgatgagttttcttatgattgttgagatccaacttccagatgaaagcttcttgacattcactgcatccatagggtctttcttctgtatgaattcactgatgcttcataagctgagcctttttcaagaaggctttctcataatccaagcaagcatatggtttctctcctgtgtgagttctctgatgtatagttagctgtgttctaaccatgaaggctttatgatagactttgcacctgaaaggtctctctcctgaatgagttctgagatgcaaaatgaggttcgacttccaaggaaaagctttcccacatttactgcatccatagaattttccttttctatgaagaactttctgaggataactgagctcagatctggtcttcaaagctgtttgacattgaatgcattaatagggtatctctcctgtgtgaattcactgatgaatcatgaataaagccttttttgagaaggctttttcacaatctgagcaagcatatggtttctctcctgtgtgagctctctgatgtacagtgagatgtgtcctaaccacaaagcctttatcacatactttgcaaatgaacggtctctctcctgaatgatttctttgacataaaatgagttctgacttccaagggaaaacttctccacatttgctgcatgtacagactttcccttctctatgatgagttttctgatgatacacaagccctgaatttgtaatgaaggctttttgacattgattgcatcagtagggtctcactcctgtttgagtttgctgatgagcaatgagctttaactcactgggaagggctctcctaaaatcatgagattcctgggatttgtttcctgcatgagttctctgaggcatggtcatgagtagtttacaagtattcactgcacattcactgcatccatatgatttctttccaaaaagaattggttataattagcaagctctgacttctggatgttatgaaagctagtgtacgcacaacagagtaagtgagataacaagaagaggtccagaaaaaggcttcttttcccatttaccataaaaagatattagtaagatggttaaatttgagtaagctctgtattttaaataataatactatatcaatgtcaatattctgattttgatcacagtattctgattatgcaaaagaatgctcttcttcctatgaaatacacacttgggttttagggtagagttcagaaaaaccatatgtacctgtgtgtggtgtgtgtgtatagataaaataaagcaaattggtaaaatcatattttggggaaatttgcaaaaagaatgtgcaagaattttgtgtatcattttggaacatctcattaaatctagaccatttggagacaagcattttcaaaaggagaaaataaaaataaagatattgatgaaaacatacatagggacactaagtataatggcctgaatgtaaaagagataaacagtgtaatattcacccaatgccattctgcacaggactcagattcttgatctaggtgctggttgcacagtgtgctgactagaaagttacctagctgtataattacattatatgtatgttataccaaaacatttttcattaataagtaaacaaaaacgtttaggccgaaatcagggaatgctcccttgtaggaggatcctgaaaagaatttggatcttgtgctaacagtaacaggatgccattaccaatgatagtgggagcaggatgacatgtcctgatttccaatttaaaagcaacatcctgtgtgtatgtttatcagtaattaacactgaccatgtcttaaatattatggcatgaatatttttaggcttgcaccctgtgaatgagtacagatttgctacatcatatagcattttttagaccataatttagatctttccatcctccaactaagatttacctttttatatgaagctttaattactttccgcaacacttttgtcaaaatctgaagtcttttaagaaccaagatgtttctgatgtttattttaatgttcagggattttggaggtgaggggctagaaacactgactcctgcccctgactcccgcccctgactcccgcatttattttcataaatgaaaatagtaaaataaattcattaagggtattatgtggagaatagaaacaagagtaaaggactgagagtatattagagaaaactatcataattttggcaagagataatggacatcgaagcttgagtgaaaataactgttagagaaaggagtagaggacctcgagatataaggagaaagtaaagtctaaacttgctaaatggactggatttgtgggatgagtgaaacggtgaagcaaggatgacttgaagtttgagttagctattagatctccaagcaattcccaggcaaatgtaggaggataaggaaatatctagcctgtagagagaaatctgtgagtcatcaacatataaatagcattgttaagtccatgaaatcgaagaggtcacactgggaacaaagaaaagaaattaccaatgatgaagcacccttacgccctccaactctgaaggctttgggagaaggagatgcccagagaatggaaaaagtccatccatcacgctcaaacaataagtacccagaaaagaggccaacttaagtcttaggaaccaacatctgtgggaagcaagataaaatgaagtcttctcagctcttcacataaatgtaagtgctgtcactctgtttcagattcattcttctttaattctgcatgcaacagtcaatgaactttcccaaagattttttttttcttgagacggagtttcgctcttgtcacccaggctggagtgcaatggcgcaatctcagctcactgcaaccttcgcctctagggttcaagtgattctccaaccgcacctctggagtagctgggattacagggcactcgccaccatgcccagctaatttttgtatttttagtagagacagggtttcgccatgttggccaggctggtcttgaacttctgacctcaggtgatccacccacctcggcctcccaaagtgctgggattacacacgtgagccaccatgcccgcgccttcccaaagatttctaacaccatatatacaggaacaccactgtggtgagcactcccaccttctaggttgctttgatacattctcatatgattcactcaggtctgtaggaaatacaaaaatcaggccaaatatccttaccccaggataaaaggcagtgctgtgatgatgtgtcgattgtgagaatctaagtcaatataaagagagaaaaaggcacattttctttgaaacgccaaacaaaagagagcctcatcaatgatctaggtatctgtagtcaccttccaagtctttgccctgttaaacacatttggaaggggtccaaccctcatggtcagctcctttactttccaggtctcccatcttgttggttctcactcacctgaaatgcactgacctcacattttatcctctattctccatgtttgaaattaaatatcactggctgggtgcggtggctcacacttgtaatcccagcactttgggaggctgaggcgggcagatcatgaggtcaggagattgggaccatcctgaccaacatggtaaaaccccagctctactaaaaatacaaaacttagctgggtgtggtggcacacgcatgtaatcccagctactcagaaggctgaggcaggagaattgcttgaactcgggaggcagagattgcagtgagctgagatggcgccactgcactccagcctggcgacagagcaagactccatctaaaaaaaaaaaaaaattaaagatatctggtttggtagcttaagagcctgtttatgggaaatgacaaagacttgaacacttataattgggcttgatgggaggtgtctatgaacagcacagaaatgtttctggaactgacacactttcagctcggcagattcaacatctactatgacagaggctgcagtgagccaagattgcaccactgcactccaacctgggtgacagagcaagacctgtctcaaataaaaattaaaaataaaaaaaagtaaaataaatacataaggaaccacccccagctgacagccagcaaagaaacaaatctcagaattagtctgccaataccctggataagcttggaagtggattcttcccagattcttccaataagagccctgttggcccacaccttgacttcagtctttgaaacccagatcaaagaaaccagtcaagccaatccagacttctgacctaaagaactgtgagacaataaatttgtgttgtttcaagctgctaaacgtttgtgagaatctgttttggcatcaacagaaaattaatacattattgacaccagaaacatcagaaacaggccagttgtggtggctcatgcctataattccagcactttgggaggctgagatgggcaaatcacctgaggtcaggagtttgagaccaacctggccaaaatggtgaaatcccatctctactaaaaatacaaaaattagccaggcgtggtgacacacaccttaatcccagctactcaggaggctggggcaagagaatcactggaacccaagaggcagaggttgcagtgagccatgatcgtgccactgaacctgtgtgacagagtgagataagaagaaagaaagagagagagagagaaaaggaagaaggaaagaaagaagaaagaaaagaaagaatcagaaacaacttaagtacatcatacattcttacatatttattcacctgtattcacacttaaggcactctgtatgaagctacatttcctcattccacctttacctgaatcttgattttatggtttctgtttagttttccttaaatttttaaattacaaatgtatgtatttccatttaatagttatttgtcttaagccttgcaaagtcattggaaagaaaggcaaaagaaagaagcaaaacctcaccggggcttttatcgtttttttcttcggttcttaggaaaaggatatcatttctaaggtatgatctagatattgtcttttctgattctgaacatcggacaaaagatctcttttcaagagaaaagaagacatgtcagagagaggcccagcttttagaattgtgacaattactcaatttccctcccttaatgaaggacaactttttaaaaacacaaagctggccaggcgcggtggctcacacctgtaatcccagcactttgggaggctgaggtgggcggatcacaaggtcaggagttcgagaccagactggccaacatgatgaaaccccgtctctactaaaaatacaaaaaaaaaaaaaaaaattagccgggtgtggtggcaggcacctgtaatcccagctactcaggaagctgaggcaggacaatcacttgaaaccggaaggtggaggttgcagtgacccacgattacgccactgcactccagcctgggcaaaagagcgaaactccatctcaaataaacaaaaaacaaaaacaagcaaacaaacaaaaagaacaaagctagggttggaaaaagccctcagaggtcagactaatcagcaccaatgaggaatttctagtcctctacccccacccctaaatacagatacagaaaaaggcaatgagaacctggaatgtcttctcccttgcatgggatcagagccaggcaagttctggtgggagagctgacactggatttctactctgaggtctggcaggttctagtatttacagacccaagttctaaactgggaatcaagacaaagtggatggaatctgtaaatctgtgcaccagcagttgtaggtttttaagtgtgtcaaatttctttatacataaatcatcttcccacttgtaatagaagttctttttaaaagttgctgacttagtcctcaaagcactgcattgtagacactgttctagaagctttctgttaacagtgatgcagttgttaataggccagttccggacactccataggacacagacacctacacacctaaaaaagtttcatctggggtgtaaaaggagaaagtcagcagagtaaggttaggtaagacccatgccctgagtcccctccccagcctccaacatgggatccatctggcccatgagagcaggaagaacaagggcaaacatgtcccacacaacaatgggattctgtaggactgcttcccacctcagccacacagcagggcagactcaccaagaaccgactgggtctgacccaccaaagactgccccagccaaagcagaactgccagatgagctcagaattaatatgcccaaggccaattccctcataatgttgcctacagaagccccagcaagcaccggctaaggttctgactactaccgtcttcaactgccttgaacacccagatagaattcactcatgtgtgtgggggaaagaaagatagatcagactgctactgtgtctatgtagaaaaaggaagacataagaaactctattttgatctgtactaagagaaattattctgccttgagatgctgttaatctgtaaccctagcctcaaccctgtgctcgcagaaacatgtgctgtgttgactcaaggtttactagatttagggctgtgcaggatgtgctttgttaaaatgtgtttgcaggcagtatgcttggtaaaagtcatcaccattctccagtctcgagtacccagggacacaatgcactgcggaaggccgcagggacctctgcccaagaaagcctgggtatcgtccaaggtttctccccactgagacagcctgagatatggcctcgtgggaagggaaagacctgaccgtccccaagcccgatacccataaagggtctgtgctgaggaggattagtgaaagaggaaggcctctttgcagttgagataagaggaaggcatctgtctcttgctcgtccctgggaatggaatgtcttggtgtgaaacccaatcgtacattctatttgctgagataggagaaaaccaccttatggctggatgtgagacatgctggcagcgatactgttctttactgcactgagatatttgtgtaaagtcaaacataaatctggcctatgtgcacatcgaggcacagcacctttccttaaacttatttatgacacagagtccttcgctcatgtttcctgctgaccctctccccaccattaccctatagtcctgccacatccccctctccgagatggtagagatagtgatcaacaaatgctgagggaactcagagaccagtgccggtgcgggtcctccatatgctgagcaccggtcccctggggccactgttctttctctactttgtctctgtgtcttatttcttatttcttttctcagtctctcgtcccccctgacgagaaacacccacaggtgtggacgggctggaccccttcaatgtggagaaaaatggccaaaggcagatgtgtgccagaaacccctacaggggctaaacagtcaagacacaccagccgctaactagaataagttgttaggcctcctaactgtacttcccataaacctcaactgcccagcacaggtgtctcaagcactgcccatggccaaactacacttcctaggaagctcagcagccctgttcaaaagcctcagttcccagagaaggcaaagaggggctaaacaccgggtagactacactgcacaaattcagctgagcttgcttctccctctcagggaacctggtgctgattgctggtaattgcctccttctggtccctccctgggaggattaacatcctaggggcattgggtccagtgcgtagactgagcttcatctgccccttgttcaggtggggggaacccatcagtaaattatagtttttataatccacttgattcatatgggacatttatagcagctatttctaacatccttttctgctataagtgtgccacttctgggtctctactgagttttcttcatgttatggggttatattttcctgcttctttgcacacctgggtaagtttgtattggatgccagacatggtcaattactgactggtagattgctttctatttctttattagtctctgtttggaaaattgctaacttacttggaaagtatggccttttcatggcttgcatgtatgctttgtgaggagagttcgaggcagcctttactgtagagcaaatctgagccacccacagaggcaatactccttacttaaggtccactgtgattctccaaatgttaggaggcgtttccactccagctggtggaaatgcttgtgtgtaatccaaggatttttctgcgtgttcatttcttcctgttcttcctccagcctagggggggtttctcacatacatatgctgattatgactcaaaaggcttgtgggggaaactctacagaactctcaattcttgagtgcagctcttctccaataatccaattcatgaatttgggccaccttgaattcctcaaaccctaaactctgtctcaattcagagagatggctgggatctgcttgggtttctcctcccaatcctgcagactggaaactttctccaggcactaagctggggcaatcataaggctcatctcattgtttcctttctgtcatggaaagctgtcctaagccctttacttctcaatgtctgatgaagttcattcatatattttgtgcatcttttttagatatttaaggcaggagattatatacattagacatttactgtaaaagaaaaagggactgtttgggttggctatgaaaaagttagtcaatatccaggtgcattatgtcatatgcattccgtactcataatgaagtatgttagtttcttttccccccttttttagagtcagagtcttattctgtcacccacgctgtagtgcagtggcatgatcatagctcactgcagtcactgcagcctagaactcctggactcaagcaatcatcttgcctcagcctcccaagtagctgggactataggcacacaccaccatgtccagctattattatttttttttttttttgtagaggtagtctcgctatgttgcccagggtggtctcaaacttgcgggctcaagtgatcttcctgccttggcctcccaaagtgctgagattacaggtgtgagccactgtgcctggccaggtaggttaatttatataatttcagaatagatacaaatttacgtttagcaacatttcaagcaccataaatctcatgttctttttggacatttaggagttattttccagtgctgatgtgattttaacatttcaagagcatctataatgctcacatataacaatcatagcataagattctctgattatagaataaaatcttaacatacttgcctcataataagatagggagattatcctggcttatctgggttttcacagtgtaatcacaagggtcctcaaacatggaagagggagacagaacactcaagtgtttgagtgatgtaagactgattggccattgctggttttgaaaggaggccccaaaccacagaatttgggcagcttctagaagctggaagggcaaagaaagacgctcccctagagcctccaaaaagaaaagcagccctgtcaacagcttgatgtagccccgtgagatgcatttggacttcagtcctccagaactgtaagataatgattttgtgttgttttaagccattaaatttgtgttagtttggtgcaacactcataaaaaactaacacaattttacttccatatttgttatattcataggttttcattacataatactattcctggggttcaagatttcattaaacacgtccctccaagactctcaagacataaaagtatgatacatgagttaatttggtgagttgccatcatttcttactttcaagagtttttcttttctacaaattctcccatattttacgaaaaatgttttccatatccattgcctctacagttgtctatgtttctttggcacacgaggcacaatttagcgctaaaagcaccatcacaatctttcataaatattcctgtaagaattcttttgataccaattgagatatcatctccaggtaaagacttcctcataacagctgcatttctacccaacatgatttcaatggtgtttaacaggtttgacttctcacagaaatgtcctccacaaccactgcctccacagtgtttcagccctaaatgagctctctgggatataatggctggaggattcctactaaagattttcccacctttctggtatcagaagatttattctgatacaatatctgtaagatacaagatataatttattactgatggggccacattcacttcatttgtgaggcttattctctgttcaaattcctgattaactacaaaggcttgatttcttggaaaaggttgttccacaatcactacatttctgcccactaggcgctcactcttgtttaacaatggcggggttcctgaggaaggcatttctataggtactgtgttcacagtcttttgctcttgtatgagttcgctcatgtataaggaggtatgactccttgaggaaggtttctccaccgtcagtgaatttatggctgtctctcttatgtgagttttctcatgtttaatgaggactgacatgtgggcaaaggctttgccacattctctgcatgaatatggtctctctccagtgtgagtacgctgatgctgaatgagcttcgacttgcttctaaaggctttttcacactcactacattcataaggtttctctcccgtatgaatcctctgatgtctggtcaggtctgacttaaaatagaaggttcttccacaatcactgcatttataaggcttatctcctgtgtgaagtctctggtgtgcagtgaggtatgccttctgagaaaaggctttcccacacacactgcacccatagagtttctctccagtatgtgatcgctgatgtctattgagccggcacttccggctgaaggcttttccgcatttgctgcatctgtagggtttctctcctgtatgggttctctgatggaccatgagctgtgactttctggagaaggcttttccacattcactacattcatggggcttctctcctgtgtgagttctctgatgctcagtgagctgaatcttcctcatgaatgttttcccacattcaccacatccatggggtttctctcctctttcagttctctgatgttgaataagctgtgctttcctggagaaggctctcccgcacacactgcattcatgtggtttccctcctgcacaaattttttgtaggtcattgagctgtgatttagggctgctgggtttaacacatctatggtatttaactccagtaagagttttgtcacgcttgatatggaggcatgatctcccatatccaccaaatgcatcagaatcttttcctgcatatcttctactctggattacaaaacctaaatgagatttcaaacttttacaatgcgagccaaacttattgtgtctttacattaaaggaacaatgctcttacataaaccaaacttatttccaagggcataactttgttgacatctttcaaaatgtttaagctcattttggttttctgggtaccactgcatatggtaaaccccccaaatttctcctaggaaaaagcacaatatgaacatccatgataattttttgtggaggtggcagaaggtgcaaaaatgccatggttttggctggcttttataagatctcagtctcagagtaatgtacctcacactctgtgaaaaaggatgatactataaaacagcaaaaggaaaatacagcaacttcagcaacaacaatggatactctataatgaatcaatacaacttgggctgcctcccaaatcggaccttgcaaatggagacagaatagaaacagaaacacattgcaactggaataaatcaaaaatagatggaggggatggatgtattcacccaacaaacactgaatagactggtatttgggatactacagtgactaatcattattctctctctccatgaacctgtcattcaggtaaagacagagaatcaacaggtatgcaaagacgtaagaaaattacagaatgtgaagaacagtacaaaggaagtggctcacatcatagggtaagaaaaagcaatgttatgcaaagaacaaaataaagaacattccaagaaaagggaacagccagtgtgaaaacccagaggcagaaaaaacttaggtgtgataaaaaaaaaaaaatgtaagagaagctggtttacccggaatatcctgagcttgagtgaagtagaaatacaaaagtttggcaaggctggcaggattaaaaacatgaagattttggaggaagactttgttagaaactggaatttatgctaagaacaatggcagtaagccaccaaacatttttttgccaagaaaacatgttctgaattgacagttccaaaacatgactgtcctatggagaatgaattgaaaagatgaaattatagaagggaatatgctggaggttatggcagaattcagatggcttgatcaggaataattacaatggagatggagaaatgtgaaaaaacaagaacataagtatggaggaggaaaagataggattcactcttagaacacatgttcccagcagaaaagcgaagaattgaggataactgctcagtatgtggcttaaaacacctatgtaggtgctggtgccatttaataaaatgagggtaaaagaagcctcataccaaccagtaaaacacacacacaaaacaatatatgaccattactaagttagtgcagcatagacacaaaggagataaaagtcagaaaagagggtggccaggcgcagtgcttcacgtctgtagtcccagcactttgggaggtcgaggtggatgggaggagttcaagaccagtctggccaacatgctgaaaccctgtctctactaaaaatacaaaaaaaaggattagctaggcgtggtggcaggtgcctgtaatctcacctactcgggaggctgaggcaggagaatcccttgaacctgggtggcagaggttgcagtgagccaagattgggccactgcactccaacctgggcaacaaaagcaaaactctgtcacaaaaaaaaaaaaaaaaaaaaagagagagctccaaatgtgccctggcatagtcaaaaactagttcttggaagtaaaacaagagccgacagcgaaagagggcagtatctggatgtaaaaatgcaacgtgatcaaatgcacagatgtcagtcctcatgttatttgacattatctgtagcattcaataaaatatatgtcttcctcctccttggaataattttgtcacttatttcatggacatcttctgactctcccaccacaaccctgatactttttctatgtggctgggttctcctcttttgaatctctgaatatatgtggacctcttctttcttcaagcaacactcactcctcatgtcttctcatcaagttccagtgctttgatggcccctgcccagaggggaatgaagccatcacatcaaatggaactcacagaaaaagagaagtcagtcaaacgtgcagcaatggaggcgataagaacctctactaccatggcctactgtgaagtgggacttcaagagtagagtgttcaaaacaataaaaattaacaggagcagctgagacattcagacgtagaacagagtaaaccgagaagactcaaggcaactccaaggtgaccaggcaccggagtgatgagcaatacagcagaacctaaatataatgcacagggagggaaaggattttccaggaggaaagagaatcacagtttctaaccctgaagctgagggaagaagaatttcacagaatactcgtccagggtgctggcaaaatatagaataagaaggcaggtgagattacagaaaaggagatatctgcatgaagctatttgtcagaagacacagctgaaatctttagtatatgtgagtatactacatgatggtagaaacaactgggagaaaggaggattctggtttcacatcctggaagaaggaaatattcggagagctgtcctggtggctggcgacacgcagcgggttagagtgcagatgagacgttagtagcagacatgctactttgcgagtctccagcaggggccagagagctcaggccctgagagtgaattaaacttctaccaggagaatcagcagaagataaaaaaaaaaaacagaagctggaaaggcggggagcagtgggtgagtaagtcgacagagatgccccaagagacatggtgtggaggcattgacgtgagctaaggtgaggtgattttcagtgaaggaaatcaggcctttccagaggggccgggatacacttttaagcgacagaagtgctaaaagtaatgcaatccagccaggcgcagtggctcatgcctgaaatcccagcactttgggaggccaaggtgggtggttcatgaggtcaggagtttgagaccagcctggccaatgtagtgaaaactcgtctctacaaaaaatacaaaaaaattagccgggcctggtggccggcacctgtaatcccagctactcgggaggctgaggcaggagaatcacttaaacctgggaggtggaggttgcagtgagccaagatcacatcactgcactccagcccagccacagtgcgagactccgtctcaaaaaaaaaaaaaaaaaggcaacataatccagatgggttacgaggggaatttcaaagcaagtaaggaaggggcaaaagtcaggagcaggctgggaagaatggaaccaggtaagaattcaaggtcttcgatgacatggactgaaatcagatccagaaaatagaagaaaggaagacattatcctttgagagccggctctattagggatggacacagatgcagaaaggctgattaggtttctgggccaccaactactgtgaagtcctctaaagaacactttaaaagcatcaacccttctccgaccagctgggatttgcatgccatttctccccattttcttagttttcactcacttacctggacagatttgactgtgggctgctccttctgctatccctgggggttctccttgctccaacttgaagagcgaatctggcttggtgcctcgataccctgtaaatgggagatcactgaacacttggcacgtgtgcttggggaatggatgaagatggagagggttatgtctcaggaaccacagcatttgcactttgataaagcaaaactctttcactcaggaaaagagcacaaccacttcgtgccagggaggaaaataacagtctgcgtgacacacccatacccattaggatggctactatcaaaaaaacaaacagacaaacaaaaacagaaaataacaattgttggcaaagatgtggagaaactgggaccctgtgtactcttggtgggaatgtaaaatggtactgacattgtggaaaactgttcctcaaaaaattaacaatggaatgaccatatcacccagcaattccacttctgggtatataccccaaagaatggaaagcagggtctcaaagagattatttgtacacccatattcatagcaacatgattcacaagcgctaaaacatggaagcaacccagtgttccttaacagataagtggataagcaaaaggtggtatatatatatacaaaagaatattattcagccttaaaaaggaaactctggcacatgctacaacatggataaaccttgagaacatcataataagtgaaataagccagacacaaaaagacagacactatataattccacttatacgaggtacttagagaagtcaaaatcctaaagacagaaagtgaatggtggtcaccaggagctggggagaagtgggggaatgagtagttgttgttttgtgggtacagagtttcagttttagaagacagaaggtagtgttggtggctgcataacactatgtgcgcgaatgcatttaacccactgaactgcacgcttatggttaagacggtaaattttatgttatatattttaccaccacaacaaaaaatctataacatataatactttagtctaaaccattaaatatttatgggaccgtacagtggtcaccaaataagaaagaaaaggtaagtgacggcaatgctgtccttacctattgatactaggttgatgtagttctccaacattacttccttgtacaagaccttctgagactggtccaaaaactgccactcctccctggtgaagcccacagccacatcttcgaatgacaatgacccctataataacaattccaatgcaatctgaggtggataacaatagatgatgcggagaagagggacggggacatgtcttgatccttttctccatgacaacgtatgcacaccatggctatttcacataccaaaggaccatggaattccaccaattctgcctaccctaaaagcacgaaggcagtactagcatagatatgaaacaacatgtaataagactgttcattattcctttgtttctcataatgaaaaacttaccaataatctaaatgtctatcaaaagcagacagggttaaattacagcacctccatgctataatatactgcaaaaatgttaaaatcaatgaggtagatgtatacatacccacatgattatcaatgatctccaaggcagtctcttaaatgcaaaaaattaagctcccaaataatatatgatctaagacatattttaaaaatgtaataatacggctgggcgtggtggctcacacctgtaatctcagtactttgggaggccgaggtgggcagatcacaaagtcgggagattaagactatcctggctaacacagtgaaaccccatctccactaaaaatacaaaaaattagctgggcatggtggtgggcacctgtagtcccagcgacttgggaggctaaggcaggagaatggcatgaacccgggaggcagagcttgcagggagccaagattgcgccactgcactgcagcctgggcgacagagcaagactccgtctcaagaggaaaaaaaaaaaaaaagtaataatatggctgggcatggtggctcacgcctgtaatcccagcactttgggaggctgaggcagggggctcatgaggtcaggagttcgagaccagcctggccaacatggtgaaacccccatctctactaaaaatacaaaaattagcagggtgtggtggcacgcacctgtaatcccagttactcaggaggctgaggcaggagaattgcttgagcccaggaggcagaggttgcagtgagccaagattgcgccactgcactccagctctgggcgacacagcaagactccaacttggggggagaaaaaaagtaataatatttataattacatatgtataagtatacacaagtatgtatacataaatgtacataaatatgaatatattctaccagatgtcaatcacagggaggaactagatagagacccaaactatgaacacttatttagtatcctttgggttgaagtttgggcagaaaaagggtgaaaggagatactgtcttttgatacaaatgcttctgtttgcttgaatctcttgcgtgcaaatgtagccatgtatcatttcagtaattaaacatagaaaaagcaaaacaagccgaactggtgctttgttttttgaacctggagttaagaaggtaagaaagaagcattgtcagtatctgcattccaagctgttaccaaagaatggagctgttaattgtctcctgctgtctcaataacaaaaatctggatgagagaattcttcttcagggaggatcattcaaaggtcaagcagcccattcattctactggatactccaggctttatcactgggcaaagtcagatgaccagaagcctctattttcaaggcacgctattttcgaagaattttgtccaatccagttttcctttggcattactccttagcttaccccactaaacaacaggaaaaagccatagaaaacatcccatgcctttattacaaggctgactttgaggataccgtcaaccacaaaagctctctgaaggaaagaagtttctcaagctctcacagcaatgacaaatttacctcccctgaagaactgccttgctctctcctcacagacattacaatcgtggcatttttcatgtgtttcctgttatttcagctgccaaaaaaaaggagacacagtttaaagcagagaaaacccacagggtcttaacagtcacttagctatgttccgacattaagaactttcacaaaccccctgatccatatatcttgtttcttaatttgccaggattttaagattccaacttaaacttattttcccacagatcctgatttttatcagcatacactatctcatttaaccagactgtcttttacaagcttccacagacccattgggaaacaaacgacaaaataggtaaaacaaacctcacctgggccttgcccatttcgttcaactcttaggggctagcaactctagtatgttctctctcttctgtctattctgggccttcccagaagtggtggtcaggtatcatctcaggtcaagctaccactggaaatgatgatcttccccagcctggaagctccttcttccattactgaaaatgtcttgttcctataggccagaacctgtggattcaagaccaaattcaatgataagaagacatgctcctaggatcacaagtctccaattgccatctggactcacattaacatcaggttccaatatttcatctgtctccttaacaccctggaagccattacatcatggggcagtgatccagaggaagatatggaatgtgcaagaggaatgcctttttttttggttatgtcagaaatagagtggatgtgaaacaggagaaagtaaacaaaaaccacctatggtcttgtccactgccaagttctcacatatatcagttttaggtaagacaatgaaggaagtggtaaagccagacatggtggcatgtgccctagagttccagctattgtagaggctgagatgggtggatctcacctgagctccagagttcaagaccagcctggacacatggcaagactctgtctctaagaataaaaacataaaagaagtggtggctcaagaaactgacttaaaatcaccaccggcagccacatgctcctaaatttttggtttattgcactgtcttactaatcatacaaaccataagcactgtcttactaaaccctcgatactactttataaggtactcattattatttccatcctaaacatgagtaagctgaggcttgctgagacaacgtgtgttgtgcaggttaacattcttcctcattagtagcatgggaacttgaatctacatctggggtctctcccttgtgatacttccctcctacaacagccttacagtgcaaatttgttctctttcctacccacttttagaactttacttcccagcactttacactgcggggtggccacatagtcacagctacacaaacaagggcctgtgatctcctaatgcaatattcagtgtggatgctcagcctgctccttccacacagacaggaaagcaaaggcggtcccatctttgccccagaagcagcagttcagagatcagtctccccaagaaccactctagaaactcacactctgagaacacccacactgtgagaacaacttgaattttgctgtcatcccagcaagtcattctcaagactctctagcaagcctgtatcctttacacccagagagctgatctccaagccattttctgacccactggtaaacgcactggtcaagatgcaaacctcctctaccttcaatcctgagaccgcttcatcccagccccagcccttcagtctagcctccctacaggaccagtccaaaaacagtggtacccaacccaaatgcagaaatccatatggatagctaagaggtagaaaaggccattacgcatgaatgggttggagctgagatctccagggttgaaaaatccaggatccaaccattcccagaagctcatggcaggctttccctcatacataatacatcagaattgcaccaaatactcacgcggagaacatggcaatgtaaccgagaagggcaatgataccaccctgactggtaaggataatctggatttcctactgaactgaggttcaggtcaaatgtccagaggacactacctaaattaaagaggaattttcttaagaaagggggcttggttgtcagattggcagccaacagtatccaataaaaaaaaaaaaaaaactagggtctgctgtgttggctcaggcctgtaattgcagcaattctggaggtgaaggcaggagaattccttgaggccaggagttcaaaaccagcctgggcaacataccaagaccttgtctctacaaaaaaaaattaaaaatttgccaggcatggtggtgcatgcatgtagtcccaggtacttaggacggtgaggcaggaggatcgcttgagcccaggagttccaggctgaattgagtttatgaccgcatcactgcaccccaacctgggcaacacagcaagatcctgtctcaaaaaaaacaaaaggcaaaaaaaaggcttccacttcaaataaaagttaggatgcttccaaaccattacaagccctcagccttatctgcttttgggaggaatgaagcagggaggaaggaaacaggtgatttctcccatatgatgtcctacctttggatatggctgactgctgtatcagggtatcattttgtgtgggctttttaaaaaaaatttttttttttttttttttgagaaggagtctcaatctgtcgccaggctagagtgcagtagcgcgatctcagctcactgcaacctccacctcccgggttcaagcaattctctgcctcagcctcctgagtagttgggattacaggtgcccaccaccacgcccggctaatttttgtatttgtagtaaagacgaggcttcaccatctttgccaggctggtcttgaactcctgaccttgtgatccacctgcctcagcctcccaaagtgctgggattacaggtgtgagctactgtgcctggccaaattttttttttttatagagacaaggtctcgctatgttggccaggttggtcttgaactcttggcctcaagcaatcctcccacctcagcctcccaaagtgctaggattacaggcatgagcgactgctcccagcctcatggtatagtttaacttgttgttctctacctacccaactcccagtttttccttttaattaagtgagtagttcaacttagaggtttgattagtcccatgttcaatttttttaggtaagaatccttcatggatggtgctgtgtacttcctactgcaacatatgaagaggcatgagggcaaaaaaaacaaagaaaaaaaaagggggagctgttatagaattaaagagatctaagagatacaacaagcaaatcgaatgcacccacatcatttggatcatgattcaaacaatccaatgttaaaagacaatgatgagatgatcagaaaaaaactgaatgtggactaactattcaatgaactaaagaaataggctgggcacagtggctcacacctgtaaccccagtactttgggaggccgacatgggcagatcacttgaggtcaagagttcaagaccagcctggccaacaggaagaaaccccatctctacaaaaaaatacaaaaattagcctggtgtggtggcagatgcctgtaagcccagctactcgggaggctgaggcaggagaactgcttcaacctgggaagtgggaattgcagtgagccaagataacgccactgcagtccggcctcggtgacagagtgagagtccactcacccaaaaagataaggaaagaaattattattaacttggatacactgaaaatggtctaggatgggtgaagtggctcacacccgtaatcctagcactttgggaagccgaggcagaaggactgcttgagcccaggagttcaagaccagcctgggcaacatagcaagatcctgtctgtaaaagaaaaaacaaaaaggaaatggtctagtggttataaatttttttaatgaccttactggttagagattcatactgggatacgtacaagtttcaaggcatgaagccttggatttgctatgaaagtctccagactaaaacaaaagtggaggcacagataaatatgactgatatgacagatgaatatgaattgataaccattgaagctaagttatgggtaaatattatactcaatttccatgaaaaaaagttagagtcatcagagcctgatgagttctatctaatctttacagtacagagatgactccaatattatgtaacattcatcaatcacagaaaaagtgaagcctctctaacaattatataaaaccagcatttccaaacacaaatcaatagaataaaaaaaaaaagaattatagagataggtgcttttccattgattttcatccttccttcttttctaatacttgcattcaaggttataaatttcctccactgactgcttaggttaaattcaacaagggtttacatgtagaattcttattaaaatgcaattgaaaatatttccactgtgattttttgaactcagattatttagaagcgtatggcataattaacaatcattctgacaagaaaacagcatgttctgaattgatagttccaaaaagtcacatgactattctatggtgaataaatcattttgatattgatttatagcttaattccactatagttagagaaaatattctatatggttttaatcatttgaaatgtatttagacttgcctgatggccaaccatacggtgactttttataaatgtcctatgtgcatctgaggaaaattattgagtgcagtgttttatattggtcaagtttgttaattaggtatgtcattctaacctttcaggggttgggactattgtgggttagctgaatgtttttgtaaataatgttttatcagaacacagccacacccatttgtttacacattctgtacagctactttcattctataattgcagaacctagtagatgcagacaagaccatttagccggcagagactaaaatatttgtcatctgtctgcacctttacagaaagtttgccagcaatggttaatctatacccttttagctttttgtctgcctgttctctcagttactgagagaagtatgttaagaatttcccattatgattgggcatttgcggtttctccttgtgtctagcatactccattcctctatacttaacacactaagtatatgctctattgacttttttttgagatggagtttcattcttgttgcctaggctggagtgcaatggcatgatcccagctcactgcaacttctgtctcctgggttcaagtgattctcctgtctcatcctcctgagtagctgggattacagacacccgctaccacgccctgctaatttttgtatttagtagggatggggtttcatcatgttggccagatgtctcgaactcctgatctcaggtgatctatccgcctcagcctcccaaagtgctgggattacaggcgtgagctctcatgcccagccctcaatagaacttttatgcaccaaaagacatgtagaaaaacgttcatatcaacaatactcataactcccataagccataacaatgtctcttgatagtggaatggataatatggggtataatcatcaatggaatactacacagtaatgaaaaagaaacgagctactgctatatgcagcaacttagatgattttcacaacaaaaatattaagcaaaagaagccagccacaaaagaatgtgtaccttaggatttcatttatataaagatgacaaccaagcacatctatgatgtttttaagataataattacctttggagaggagagagaagatgagggcttctgggatgctacattattctatttttttaacctggtgattttcaagtataatcacttgaaaaaaacttaagagaccaatttctcttataaatgtataggcaaaaaaattttttaactttctactatgaaaaatttcaagcaaaagaacagtatactcaaattccacatattcatcatgtgacttcaagaatgacgaactcacatctaattttgttttatctataccaccattcagtccctctccagcaatggattatggattattccgaagctaatccaagatatcttttcattttttgatgcaaaaatattaaataaaattttagcaaataaaatccagtctcatattaaaagaacaaaccattattgacaagtatggtttattccctcaggaatacatgaaattgggaaatagagcaacacaaatcaaagaaaattttaaagagaaaaaaataaatgaaaataattgtaatggtcaaaagcccttaggaaagagaaataaaaacttgataaatcacagtaattatttattcagaccatactacgtacctagtactacactttgaacatacttaaagaacatttgctcacttaatcttcataatgattccatgaaaaagaaactatgacagcttttttccacaaataaggaaactgactcagagattaacgtacccaagtcagaggcagaggcaggtacttcttactccacagtccatacacttgccacctggctaaaattatttgcagatgacaaaaatgctcaactagaaaaaagacgtcaatttataagttatatgtaatgacatgagtacaatgaagtgacagaataaacatatatatttttaacttctgttcttgtcaactaagtaaaattaggaacaaaaaaggaaagggggaggggtcttatgcaaaaaaaaagtcacgatttacaacaaaaagtattaactatgtagaaataagcataaccagaaatgtccaagatacgtatggaaaaacactacagatagtcaaacaaataaaaatattgggttaatagaaatccatcacatgttcctgaaagtgttgtatctagatctacatcaattctacccaaattaaagcaaccacttgatgaaactgcagcaatttaaaaaactctcaaagagcatgtaatatgggaatacgaagttgacaagatgttattaaagacgaataaaattataccaatacctagacacctgatcccaacattaaacatgaaatacactaaaccagagttattttctggaggagtatttaaaatgatggggatgttattacttgggtcgcaatgaacctgaaaacccattttctacagaatatacagcagcagggaagcaaggggaccagcagacccctttttaagtacgcatgtgataagcaatgaacacgaactgcccagagcagtctccaacactgacacgattcgcttccccaccacgacgccctagcgctactgtgcaacgaagacctcccaagcactggttccaatgcggagaccatgggctcccagactctgggaactccaacacgactgcgaaacgaactccgagcgaggactccccgagagctccccgcaacacggacctcacgcgctagcgaacaacagaaaaaaaaaagcgcgctctccctgcccctgaaacattcccagaagcccacgcagaccagaccgatgacctgtctccactgctggaggcgagtcagggacccgaagtctctaaacactcgcctctacccgccgccccgcgaaccccacacactgcagacgcgacactcgcaagtttcggggatggcggccggcgagggccatactgcgtctttccggagacacggaatacggcaccagccgtccctttatgatgcaatatgtctgcgcccaggggacgcttgctgggagcagccattttcaaccctactgccgtagagcaggcggagtccctcttttcgcgccttaagacaggtaggttctgacgatgaaaagcaattgaaaacgacccatttcaccctttttccagtccacgtgaactgctagatcttggctttgcaacattagccaggggcgctacataaactgcttagtttctcaaaggctcaagcctgccctgatctgtctacaggatgggtagagatggtcacagacatttaggcactttgatcctaagaagaatggaaagaaaccatgtggcgcggcagtcttacaggaatttcaagagggagggacctgagcaacaatcggaggggttattactcctgaggatgcatctggctggagaaagcagcctttgagaactgcctaagaagtatctttacatctacatcagatgtagcctcagaggaaggagtcagtcatagaatggataaaacaaccgcgtgttaaagctttggttataattggtgtggagaatggagaacacagttgatcagcagttgacaaagtggggaaccaacacgaaaacagggctctctcaccctggaaaagccaaaggcagaacaagcctttacatccaggaaggtgggagcaacttgaaatcaaaactctgaaggggagatgattctgttcaatactgaaactcagctgatcaattaactgatgaattctagcaccaaacctgctccctataattttataaccagcctcagagaacctttaaagggattgatcattcactcatttatccagcgaatgtttataaaatgcctaatgtgtcaaacactgttgtgcgtgctgggaatacaacagttggaaattcaggcacaaagactctcattcatggagattacattctactggcaatttcagtgtgtgagctaaattgagtggtgctaactgttgacttggctggttgactgaaacttggactcaaaatttgcctacactaaatgaagtttaaatgccagaaatttcctcatatattataaagtacccaaagataaatggagtttggaatgctagaatgaatttatcatgtaaaatcaagattacccatacctcaaatatgtattccagtagcatctagaagacaatctcttcactgacactgatctggtcacaggaaatagagatatactactgtaagattattttattatacagtaagtgatataatgtccttgaagttagaatgataagttcatgattttctttcagtcagttcaggctactagaaaaaatacaccatagactgactgactgccttaacaaacattcatttctcacgttccagaggctgaggagtctctagaactggactctaaaacacaatcaaggtgttggcaggtctagtgtccagtgagagtccatttcctggtttatgcatggtcatctcattctgtcttcacatggcaaagagcagagaaagagaaaacaaactctcttctgtgttgtctcataagacacataatctcatcatgagggttccactttcaagatgtaattaccttccaaaggtcacacttcctaatgccatcccttagggattaggacttcaacatgtaaatttggagaggacataaatatgcaatccctcacaatgatgtatgctataaaatctcaaggaatcaaatgacaaggatttacagttaataagccaacaaaggagacaatatgtaatataaacacactcagctactctaagggaaagcagaaaaagaagaaaaggagaacaaagaagacatagaataaacaacaaatagtaagttagtaatttaaacctaaaaacatcaatacattgaacgtaaatgatctaaataccccagtaaaaagacagagattgttaactggataaaaaaggaaggcccaactgtatgttgcccactaaacacccactttaaatatgaaagcataaataggttaaaagtaaaaccatgataaataaagatatgaaagatataacagggaaaaacccatgtcaaattattagaggttaaaaattacaatttctgagagaaaacatactttggatgggattaatgacagattaaacactgtggaaaaaagattagtgaactgaaagacatagctatgagaactataaaaaatgaaataatgaagggtaaaataataaaaagcatgaacatcattttcatgtacatatgtgtatacacaaaaagatttgtgaacttgaacaaggcaagagatacaatctaaactacaaagagaacaaaagctaacccctaccttggcccccggagtaagagatatcattctgaggaacaccaagtggaagcctctaaaactgcccccctccccagccaaactctatgatcaagatagtaaatgaaaaacaatattgtgggaggggtagtgaggtttataagatataaaaaagtaaaatatatttcatatcttgtaaaccctactatacatattagtgcagggagccaaaggcccatgggacatgacaaactcagcattccgctggaggctatatgatcaaacagcaaactgtttatcatgaatgcaggatgtgggcaaactcacactgccctgccaccattgccacagttaccatattaacagggcttttcccctgcacatgttcactaggacttaagctgtgacttgctgtggaaggattttccaccttcactgaatccccccgtttctcccttgagtgtattctcttatgtttaacaaggcaagacatatagaagtaagctttctcacactcatcacagccatagggtctctctcccgtgtgagttctgtgatgtacaatgagcattgtctttgtaaggaaggctttcccacagtcactgcatttatagggtttctctcctgagtgaattttctgatgtctaatgagtcctgacttctgtgaacagggttgcccacattcaggacatacaaagggagtctttcctgtatgatatctctgatgtgctacaaggcaagacttctggctgaaggccttgccacagtcaatgcatccataaggtttctctccagtgtgagttcgttgatgtatgttgagattgcccttctgaatgaagccttttccacattcactgcatgtatgaggcttctctcctgtatgagttcgctgatgtacaacgagtagtgattttctggagaaagctctcccacattcgctgcattgatggggcttaattcccgtgtgaatcctttgatgttcagtaagctcagatttcctggggaaggctttcccacattcactgcacccgtatggtttctctcctttgtgagctctctcgtgttcagtgagcctgtacctcttgtagaaggctttcccacacaagctacacccgtggggtttctctcctctgtgagctctctcgtgttcagtgagcctgtacttcttgtagaaggctttcccacacaagctacacacgtggggtttctttcctgtatgaattctcttatgctcagtgagctgagacttcttgaggaaagctttcccacagtcagtgcattcatgggctttctctatgttgtgtgtttgctgatgtttaaggaattgtgacttggtgctgatgggttttctactttcagggaattcaatttccgtaggcatttgttcatgattatcatggagaaaagctccatctccattaaactcagcaggctcctttctgttgtatcttctgctctggttggttaaacctaaatatgatttcaaagttcttccgtgttcatagcgttgtcccgtcctcttcagtattttttggttttgcaagggctgctgcagatgatcatcagctttctcaatttctaagagagagaacaataaatccttccatgatcatcacacggaataaaactgcttcaaagatgccttggggttggctggctttttactggaacccctataataccaacatggaaggaattccaagtataagtgttccctatctgttaaaaaaacttttaagaattgtagttaaatacatataagataaaatttgccagctgggtgcggtggcttatgcctgtaatcccagcactttgagaggccaaggcgggtggatcacaaggtcaagagatcaagaccatcctggccaacatggtgaaaccccatctctactaaaaatacaaaaaaattggctgggcgtggtggcacgtgcctgtagtcccagctactcaggaggttgaggcaggaaaatcgcttgaacctgggagacagaggttgtagcaagccaagatcgctccactgcactccagtctgccaacagagcaagactccatctcaaaaaaaaaaaaaaaatttgccagccaggcacagtggctcatgcctgtaatcccagcactttgggagggtgaggtgggaagatcacttgagcccaggagtttgagaccagcctgggctacaatagggagactgtctctacaaaaactttttttttaatttaaaaaagaataatcctgagtagggaaacagcagacataggtagtagaataaatatcccagaaaggcaagttagaatgttggatacacagcctttgacttcatcctaatcctattagactgttgggtgctaaaatatgcccttctccattctgtagaccatcatcacgctaactttcctagagcaccaatctcatatttccaggaaaactgcagtcaatactctaacctttgttaaaacagagatcacaagactgatggaacagactctttgtagcaataagataccaaactataaactaggtctaaggacatacaggtaagggttaagtcacacaccccctacatttaaagaataaactatgttctaactgccacgagtgttttttgttttgttttgttttgtttctttttctgtagcagctaaacaaacactggccttgggacaagcaatattgaaacaattgcagctcccggaccaccagatgctgactaactgatgcccctcacccccaacagcattccacaggccataactgcagctatgattggacaggagactgatctcaatatccttctcctgataaacaccagctgttttggtcagctgccggagtctgtgcagacttttcttatatcctgtaaaagacctgctagcatacagtcaaattccacctcattttaatgttaaaactccactccaaaatgaaagtggattatatgttacatatatgtttgctcactatgcacatgtttgctgattctcataaagatattcataagactccccatctctcactgaataggtatgcaaagcaaatcctagaaggcaaaaagcctcctgcaaggcaaaaaaaaaaaagtttcccctcttcagtgatgtgtgttttttccacttcctcaaagtcacaccactcagatctgcgaatcatcttttgttagaatataaagtttctctttgcctcctcaattttttggttaacaccttgtatctacctggctatgatatattctcatatgttccaacagaaagagaaacagggtgatccctatggactttcagaacatgcaagcagaacacgtggtcctctccacacagctctgccactgcaccaaatatggaaactgtcaccttcttcatcatgccctacttgcacagatgtcatattggattttttttccactttgctgtccctaatatactaattcctcaccttgccactaacagcctctactctctgaattttgtacttatgtctctgttggcatcggtgaatggagccctcaaggaccacctccctacttctgaatcaagacttgaggcagctttacttttagtttttcttagaacatcagctatacagtatgattgctatagtactgccaccaggtgaaaggtaagctctacctagagctagaaaaatacaaaactttacctccaccactaccctgaattactggcacagaaaattcacagcaggagctgaacaataaaagttttaccattaccatgacgcatccactttaagttcccacttcaccatttcccagcaaatatcttctaactgtggcctccatgtgaccagtttcaagctaatcttttttttttctttttttttgagatggagtcttgctctgtcacccaggctggagtacagtggcacgatcttggctcacttcaacctccgcctcccaggttcaagcaattctcctgcctcagtctcccgagcagctgggatgacaggcacgtgccaccacgcctggctaattttttgtattttatgtagagacagggtttcaccacattggccagactggtctcaaactcctgacctcaggtgatctgcccaactcggcctcccaaagtgctgggattacaggcatgagccaccgcacccggccttcaggctaatcttctgacagtccccacatggccttgcatttccagttctacaacttcttgtcatatgtcttcatcttaattcaatacctagctatgtctcttgcataagatattttatcagtctgtctttctccatcttgtctagaccactgtaggttacatttcttctaaagtcctacaattctttctgtatttactattcactttaactttgtatagccctgaattgtaacaaaaacatttcacacgttcaaaagtttaatttgtaaatattacataaaaatttgccctatttttgctaacaaaatctttgctcaagaaagacatttctgtttctcactaaattcagtctcttctactgtgtattatggctacagttcatcaactcataaaaacagcccccgagagagcttcatgtaaagacacgcccaggcccccaactcaattctaacaaaaccagactcacagagcaagaggccttggtatggacagtgtcatgaaaactcctttaataaagatctagcctttaagaaatgcttaatagatggaaaagtatgacctctcttcagcctggctaatctgtccttcgatgaagaaatgcatgaatgaccaagatgtatttcaatcttacatgaagaagaatgaaaaccaggcccttgactccagagtagcaaaggaacctcaagcaccaccaaatcacactgatgtggtatctatgggagtggcttgtgtgtgattgggatgcaaagtagaatgggaatttagacatggaagatattattatattgtagtgtattaaaaaccatttcatgaaaagaaaattcaaggtgaaaaatacatagtgtcagaatgtgaaaaacaaaccataatcacataccgatgcctcagtttttttgtttttttgtttttcgtttctttttgttttttgaaacagagtctcactctgtcacccaggctggagtgaaatggcgcgatctcagctcactgcaacctctgcctcctgggttcaagtaattctcctgcctcagcctcctgagtagctgggactacaggcacatgtcaccacgcccggctaatttttgtatttttagtagagatggggtttcaccatgttggcaaagctggtctcaaactcctgactttgtgatccgcccgcctcagcctcccaaagtgctgggattacaggtgtgagccaccatgcccggcctcctatgcctcagttcttatctcacttgatgaatcagtaactctagacaatgcttatggcactctttctccctctctctcttatataaatgtatatatacatataaatatataaagtatatatataaatgtatatacacacatacacacacacatacacatatatacacacacgcatatacatataaatgctgttctagcaaattaatcaaacttgaggagagggtcttgggaacccctactttacagctggttggtcagaagctgaggtgacaacctgggacttgccactggcatctgaagtgggacacagtcttggactgagcccttaaccggtgggatctgatgccgtatcaggtagatagggtcagagctgatttgaaacagacgatacccagctgatgtctgctggagaattgcctgggctgtgagaaaacaacccctatatatccagtggcataaatgctgtgttgagtgactatgtgacagagaaaaaaacagtttgtcgtttttgcctcagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggtatgtatgcttctctgaattcctataagaaaaagagctcttgtatcctaggggagaagaagatgtggcagctgtttctgtctccctagacactttcacaactgtcatgccttctctaaatgaccagaatgtgacttccgctgccttcccctcttgctggttctctctcacttacctgggtgggctggactgtggatttcatcttctagtgtccatagtggttctccttgttccaacttggtgagggcatcaggtttgccggcttgataccctgtttgtgggaaatgggagaagacttaggctcactgaattgcaccacgtggctctgatgataggagaaaggtacatgttagggactgcataatttgcatgttagcaaattaaaggctttttttctaagacgaaggaagattatgcctcttcctgtgggaccagagacgggcctgaggatctgccatttgggagcacagcagacataccaaagcttccagaagctgagaaagcaaaggccactgactgggtaccctctgagtgacacagggcagctgtcctcacccactgacacaaggttgctgtagttctccaacatcacatcccggtacaggtccttctgagcagggctcaggaactgccactcctcccaggtgaagtccacagccacatcctccagggtcagtgattcctgtaataacacagtcctgcttaatatgtttctcttttattgacatggaagaaatatgaagttgttcggcccattttcaccacataagctgcacctgcacagttgtcccttggtatactcaatggaatggtttcaggatgccccacatataccgaaattgtgcatactcatgacctacagttggcctagtggaatctgcttatgttactctgtataagcgagtttcacatcctgagaatactatatttttgattcaagtttggatataagtggacccttgcagtacaaattcatgttcacaaataaactgtattcctagttttttaaatatactgtgaaagaagcaaagtcatagtaaaatattctatattttataataaccatgcagccatccattaatccaacaaatcataagtttctgtaatatgcagccattaaatcctcttgctaacatgagaatgtctgcagtgtttttcagcacctacttgcaaccctaaactatatgctacagtcatatagtacgtgcagaataatctagcatgacccccttcatgtaaactataccatgatatttagcaaaacaacaaataaactatgcagtggccataaaaaataagccatcatacatgtaagcattgacatgcatagatacatgtatatgtatacaacgcatgtatacacacacatacacacgcatgcagacatagatgtcctcacaggtaaatccctagaacaggaagacaagcatttgttagtgacatactagggaattaggaaaaaaagtatacagagggggaactttgttttcacactatgtgtactatttaacttgagtctttcacattgaaaatctatccatgaggccgggcatgatgtctcacgcctgtaaacccagcactttgggaggcaaaggtgggcggatcacccgaggtcaggagtttgagaccagcctggctaacatggctaaacatggtctctactaaaaatacaaaaattaggtgggcatggtggcacctagatgaagcatgagaatcgcttgaacccaggatgcagaggttgcagtgagcgaagatcacgccactgcactccagcctgggcaacaaagtaagactgtctcaaaaaaaaaaaaaaaaaaaactatgaatctgtggttctttctgacaccaaatacacagtgtcttttccagcaacactttctctgatgccaactgggtatcctagagttcgatgctatgctaacactaaccgctgagggttatcatcagactctgcaggtttcagggctcggtcccacaagactgccctcacatcatgtgccactctggggtccccacgttatcacacttctgtccaacttgaccacaactggaggttgccacaacctccctgctcaggttcgataatttgctagaatgactcacagaactcaggaaaatgtcacacaattacagtttattatataggatacaaatgacagccaggtaaagaggtacagaagtcaaggtccaaagggtgccaagcacaggagcctctgatcccatggaattgcagtgcccccttcccccaccccccacttccacatgtgatctccaaaccccatgggggtttttatggagcttctacgacgtgggcatgattaaatcatcaaccatggctgggtgcggtggctcacacctgtaatcccaacactttgggaggccgaggtgggcagatcatgaggtcaagagatcgagaccatcctggccaagatattgaaaccctgtctctactaaaaaaaaaaaaaaattagctgggtgtggtggtttgtacctgtggttccagctactcaggaggctgaggcaggagaattgcttgaacccagaaggtggaggatgcagtgagccgaggttgcaccactgcactccagcctggcaacagagcaagactccatctcattaaaaaataaaaaataaaaaaaagaaatcatcaaccattggtcacagaatctggaggtcgggggtgggactgaaagtcccaactctgtaatcaaggcttggtctttctggcaaccagccccatcctgaggttgtctaggagcccattctgagccacctcattaccataaactcaggtgtggttgaaaggcactggttatgaagaacaaaatacactcctatcactcaggaaattccaaaggttttaggagctctgtgccaagaaccagagacagagaccaaatatatatacgtgtaaaaccataatgagtcatttgcataattttttaagttaaggcattaaaagaggtgagaggttaataactggatttgaacacagggaagggctctgtattttctgagacaacatgacattctaaagcaaaccctgtggatctcaacaacccaagccattgccaaagagaactttcaactccctttggtcaaatctgtacttaaacaccagtttagtgacctgttcatggagctcctttgaaagcaaaccttgcattttttaggcaattaggtttactcacagataaacacagactgcaacaaggttgggtatataggccgcagtgctgtgagctctggaaaaactgtgttcattaaacccttcttggtatagtcccatagaggactcagaataatcatgtagaaacagtcacacaaaacttgcttgtgtatcttttggaaaaatgctgttaaggacaaaaagtctatcttgtcacctctagcaaaaagcatcaaactaatttcccaagatttaagtgccatgaaatactgacatcccctgaggaacggacccgctttctcctcagaatcagtgcacatcatgtaacttaccatgattctctgggtgtgatggtggccaaagattttggacacaagctgacacttaatgtagccaacagggtctggcagagtcgcacattatattccaacactggtcacatgtgaactatgtgaacaaagtatttgtgatcccactttgtcctggattaaaggtacagtctaagtctgtttctccccagagctcattttttccaatttatacttttaatgtaaatgaactgatttcttcagacttccacaaatccatcagggaatcgagttaagaataaaacaaaccaaaagttacctgggcctttgtcattttcttctgtttcaggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacattccctccgggcccagatgctgtctctgctgctgtaaactctcctgcagtcaaggccaagcaatatatctaagcatccctttgtcaggtgtccccaagtctttacatcccagggcaataaaacaacactctgaatgtggggagtcatatggcagtgggcttaaccaggagccggcatatctggccactttccaatgcttcaaaggagtgtctttctccttaagcacagtgtttataaataagagagcaggtcacgctctggtcatgagaacgtgatggtaataaggaggctttcctcctcagaggcctcctgtgattttccaaaacttattgtcccatatttttatggccagtttatgccagcaccccataagcctttttcccaacaatcgtgagacacacagagaagaaacacacaggtaaaagagaaggccatgtgaagatggaggcagagactggagtgatgctgccacaagccaaggacacctgagagtctgttagaaaaggggagacaggtgaatgaatgtgggcagctgtgccggagcccctcaagaccactcccagatgcagtgattcactaggtgaactcacaacactcagtctataattatattcatggcaaccacttattactgtgaaaacatacacagcaaaaccagcaaaggtaaaaggtacatgtggcaaagtctggaggaaaccagacataagtttcaagttcagtctctttggagtcacacaggatacacttaattccccgagccacaagtcatgacaacacacgtgaaatgctatagaccaaggaagtttattagagagagattgtgtgccatggtttttattgggggctgatcgtgaaggtgctcactgcctaacattcaccaaaactccagaatcctagaggaaagcatgtgttcaggataaatcacattgtttgaaaaaaacagcttaggcacagtgagccactcttattaggaaatagtgggactgcctccaaaaatctaagctcccaaatgccagctgctatggtttgaatgtttgtgtcctccaaaattcatgttgaaacttaatctccaatgcaatggtatcaagaggtgggcttttagtaagtgattaggtcatgagggctcctcccttgtgagtggcattaaggcccttataaaagaggctttggccaggcacagtggctcatgcatgtaatcccagcactttgggaggctgaggtgggaggatcgcttgaggccaggagtttgaggctgcagtgagttgtgattgcaccactgcactctagcctgggcaacagagcaagaccctgtctcttaaaaataaaaaaataaaaaaaaataaaggccgagcgtgttggctcacacctgtaatcccagtactttgggaggccaaggtgggcagatcacttgagctcaggacttggcaacatggtgaaaccccatctctataaaacatacaaaaattattcaagcatggtggcacatgcctgtattcccagctactcagatggctgcggcaggaggactgcttgagcctgggaggttgagaggttgagactgcagtgagttaggatggtgccactgcactgcaggctgggtgacaaagtgagactctgtatcaaaaaaaaaaaaaaaaaaaaacctaaagaaagaagaaataataataaaaataaaagaggcttcacacacagatcggccctttctgctcttctgccttctgccatgtgagggcaccgcattcttcacctccaaagaaatagcgacaaaacaccatattgaaagcagaaatcaggccctcaccagacaccaaacctgctggtgcttcgatcttagacttctcagtctccagaactataacaaataaatttctgttgtttataaattatccagtctcagctatcttgttatagcagcaccaacaaggctaagacagcatcctataatttaattcagtctgagactgtgtatctagatatagtgtcagacaccacagattaagggctcagttcaagcctgcccccaacttcagacgcaagttgcaagcagcaggttgtcacctgtacctctgatggaccagctataaatcaggattcacacggcctcctcctcaggttcgattaatttgctggatggctcacagaactcaggaaagcacttaacatttactggtttatttcaactcttttcctgtctagaaaaacgaagtgcagctcactgccagcgcttatttcattttacataaacatgctctttgaggctgcagtaaatctgattttcaatgtgaaaataaaatataaaagctgttctaggagttatttctaaacagaactaacatcagaatcatctgaatcatcagaattctcgatttggaatcatcagaattctcgatttggtaaaaatcggatccatccagtgagtcttcagccaagaactgtttgagaatgatgttaacatcacatgtaggaatgctacgttttctaggatttgacattttcagtgatcgagaactactacattttgtaaatggaaataccactactaaaaacagaatgctataagtagaatgatgtcttttgtttcccaaggcgacctactagagcgatgtgaaaataataaaagtgagatcgttcatggcaaagttatctcggggtaaatgctccagctgcaagcaccaaaggtgagtattctcagggcaaatgggaaaaggaataaaggatattacgaaggatacagatgaagaggcagatggaagggatagcacagagcaaggtttgtagcaaggggcgtgggacttccatgccctccacggaagcttattagagactcagttcaccaccctcaggcacctccacatgctcaagaatctgtaagttccccagaagttcaccagtccttttgagtttttacgctggtttcattatgtgggcatacttgattaaaacactaaccactggtgatcaactcaaccttcaacttccctgttgccaggcagagctaaaatttccaaccctcaaatgacatggttagttgccctggcaaccagcctcccccgtcctaaggccagccagaagcccccagtcaccagccatctcaatgccacacaaaaaggcactgtttactgaagaggttccaaggcttttgggagacatgtgccaggaaacaggacaaagatcgattatacatttcttataaatcgtaacaatcatagctaggcgcgatggctcatgcctataatcccagcactttggaaggccgaggcgggcagatcacctgaggtcaggagttcaagaccagcctggccaacgtggtgaaagcctgtctctactaaaaatacaaaaattagccgggcgtggtggcgggcgcctgtaatcccagccactcgggaggctgaggcaggacagtcgctagaacccaggaggcggaggttgcagtgagctgagatcgcaccactgcactccagactggacaacagagctagattccgtctgggggataggaggaaactttgatccccaaatgctcaaggagactgatgcttaagcaaactaaatattgcctgagaacgactccatacttctatatttgagtccttgtggataaactgcaacctagcttaacagacaaaattgaaaaccgaacttaatcgtatgcacctgtaacaatagctgagtggtggccagtcccagcggccatactcatagactgctgaatgttccaactgcgttcaaataaggcaaacgccgaatggtaaccaatctcactgtttctggacctcgcttccgattcctgtatgtcactttaccttttttgtctataaatttgttctgaccacgaggcacccctggagtctctgttaatctgctgtgattctgggggctgcccaattcgcgaatcgttcattgctcaaggaaactcctgtaaatttaattcggcttcaatttttcttttatcactgatttgagtaataataaaactccggtctccccgcacagccggctctgcatgaattgctctttctccattgcaatttccctgtcttaacaagtcggctctgtctaggcagccggcaagggtgggcggttatagtttcacaactcaaccccagccaggggcctgggcttgtaaaataccagattttacaagcctctgagccccacatgcctgggcctccccgaaacacttaacacacatccccgattcaccccaaaacctacaccacacaccctcgtacgctgcccagcaccccggcttcatcaccgactttaaactgcagcatttggagtgataataatggcgtcggtgataaagccggcgtgctgggcagcgtccccctagagttctccatccagtgatccagaggcctactaacagagtgaccctcagagaccccaaactctgacgccgagtctcagtcgctgaactcgacagacctttaacgcccgaccacaagaactctcccacgccggaccgcaaaggcaccccaacccaaaggctccaccgcccaggccgccagctctccccacaggctcctcagaagctccctacccctttaacctactccacggagagacccaaacactcacctgattttcttctggctacacctaaattccctgaatgcttcctttcctggcccttaaaccccggcactggcctatggcggcggacgagggcgcgagtcaattctgccgcgctaggacgatgggacatgggcttctcttcgaggaggtaacatgtccgcgccctgagccacggctctctgggcgcggccatcttggtagatctgccgtacagaagggaaacagttgttcttgtgtcattaaaccgggatgactctcctgaaagcaaaaatttgaggcgcaggagcattttctagagtttatctgaacaaacagcaattcatgaattaggaagcatcaaaccaaaagaagtctcgcgcttctatgcttaaagcattagacacaagtattcacagggtgagtgaaggagtaaaacaaagaaattatttgattagttacaattataaaaatgcatttttttaaatttgccttggaaagtccctaatgacataatagcatgtgagttgcctacttttgatcggttgagattgagttttgtccttccctaacacaagcatttaccagaaatgactcaagtgaattgttgcttatgtttgcaggttaagcaaggttaaggctgtttttaaggcctactgggttttgtttgctcaggagtttttgaattctggtctgcattttaattttgctttgacacaggagacagtgaaatggcactgatgtgttccctctcctgacacctcaacccctgcactgtgaggttggagcactaacaacagtgcactgtggggaaaagaaagagagatcagactgttactgtgtctatgtagaaagaagtagacataagagactccattttgttccgtactaagaaaaattcttctgccttgagatgctgttaatctgtaaccctacccccaaccctgttctcacagagacgtgtgctgtgttgactcaaggtttaatggatttagggctatgcaggatgtgctttgttaaacaaatgcttgaaggcagtatgcttgttaaaagtcatcaccactctctaatctcaagtacccagggacacaatacactgcggaaggccacagggacctctgccccagaaagccaggtattatccaaggtttctccccatgtgatagtctgaaatatggcctcgtgggaagggaaagacctgaccatccctcagcccgacacccgtaaagggtctgtgctgaggaggattagtataagaggaaggaaggcctcttgcagttgagacaagaggaaggcatctgtctcctgctcgtccctgggcaatggaatgtctcggtataaaacccgattgtatgttccatctactgagataggagaaaatcgccttagggctggaggtgagacaagctggcggcaatactgctctttaatgcaccgagacgtttatgtatgtgcatatcaaagcacagcaccttcttcttaagcttgtttatgacacagagacatttgttcacatgttttcctgctgacactctccccactattatcctattgtcctgccacatccccctctccgagatggtagagataatgatcaataaatactgagggactcagagaccggtgccggcgcgggtcctctgtatgctgagcaccggtcccctggacccacttttctttctctatactttgtctctgtatctcttcttttctcagtctctcgtcccacctgacgagaaacacccacagatgtggagaggcaggccaccccttcactgcacaaaccacacagatattcagaggctcaaatgcaaccaaggctgttgcgggaagtcagggaccccaaacggagggaccggctgaagccatggcagaaaaacatggattgtgaagattttatggacatttattagttccccaaattaatacttttgtaatttcttatgcctgtctttactgcaatctgtaaacataaatcgtaaagatttcatggacacttatcacttccccaatcaatatccttgtgatttcctatgcctgtctttgctttaatctcttaatcctgtcagccgagaaggatgtatatcgtctcaggaccctgtaataattgtgttaactacacaaattgtacagcatgtgtgtttgagcaatatgaaatgtgggcaccctgaaaaaagaacaggataacagcaattgttcagggaataagagagagaacctttaactctgaccgccggtgagccgggcggaacagagccatatttgtcttctttcaaaagcaaatgggagaaatatcactgaattccttttctcagcatggaacgtccctgagaaacagaatgcgcacctaggggtaggtctctgaactggcctcccccgggcgtacctgtctcttatggtcgagattgcagaggtgaaataaactccagtctcccatagcgctcccaggcttgttaggaagaggaaattcccgcctaataaactttggtcagaccggttgatctcaaaaccctgtctcctgataagatgttatcaatgacaatggtgcccaaaacttcattagcaattttaatttcacttcggtcctgtggtcctgtgatctcgccctgcctccacttgccttgtgatattctattaccctgttaagtacttgatgtctgtcacccacacctattcgtatcctccctccccttttgaaactccctaataaaaacttgctggtttttgtggcttgtggggcatcacagatcctaccaatgtgtgatgtctcccccggaggcccagctttaaaatttctctcttttgtactctgtccttttatttctcaagccagtcgacgcttaggcaaatagaaaagaacctacgtgattattggggcaggtcccccgatacaaggccagcacagtgccaagtatgtccacctcagtgagctgcggagaggtgactgcaccctttattgactgactactaggaaactgtcaagaggcagcccactgagcatggccatcttaaaggaatttcaggtgtccctacaacagagaatatgccttgagaaagggggaaaaaataggccacttagcttgggtagacaaggctcatgacaagtccctgcatctcagctactgactttaaaagttgtttggggaaaagaaagagagatcagactgttactgtgtctatgtagaaagaagtagacataagaaactccattttgttctgtactaagagaaattcttctgccttgagatgctgttaatctgtaacctgagccccaaccctgtgcccacagagacgtgctgtgttgatgaaggggtgggttgcccctcctcacctgtgggtgtttctcgtaaggtggaacaagagtcttggaaaagaaaagacacagagacaaagtatagggaaagaaattagaggacccggggaaccagcgttcagcatatggaggatcccgccagcctctgagttcccttagtatttattgatcattcatgggtgtttctccgagagggggatgtggcagggtcacaagacaatagtggggagagggtcagcagacaaacacgtgaacaaaggtctttgcatcatagacaaagtaaagaatcaagtgctgtgctttagatatgcatacacataaacatctcaatgccttacagagcagtattgctgcccgcatgtcccacctccagccctaaggcggtttttccctatctcagtagatggaacgtacaatcgggttttataccaagacattccattgcccagggacaggcaggaggcagatgccttcctcttgtctcaactgcaagaggcatgccttcctcttatactaatcctcctcagcacagaccctttacgggtgtcgggctgggggacggtcaggtcttttccttcccacgaggccatatttcagactatcacatggggagaaaccttggacaatacctggctttcctaggcagaggtccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagttgacacagcacatgtttccgagagcatggggttggcggtaaggtcatagattaacagaatctcatggcagaagaatttttcttagtacagaacaaaatggagtctcctatgtctacttctttctacacagacacagtaacaatctgatctctcttgcttttccccacagttgacttaaggtttaatggatttagggctgtgcaggatgtggtttgttaaaaaagtgcttgaaggcagtatgtttggtaaaagtcatagccattctctaatctcgagtactcagggactcaatgcactgcagaaggctgcagggacctctgcccaggaaagccaggtattgtccaaggtttctccccatgtgatagcctgagatatgtcctcatgggaagggaaagacctgactgtcccccagcccaacacccgtaaagggtctgtgctgaggaggattagtgaaagagggaggcctctttgccgttgagataagaggaaggcacctgtctcctgtttgtccctgggaatggaatgtctcggtgtaaaacccgaacgttcgttctatttactgagataggagaaaactgccttatggctggaggtgagacatactggcggcaatactgctctttactgcactaaaatttttgtgaaaagtcagacataaatctggcctatgtgcgcatcgaggcacagcacctttccttaaacttatttatcacagagatctttgctcacttgttttcctgctgaccctctccccaccattaccctattgtcctgccacatccccctcatcgagatggtagaaatagtgatcaataaatactgagggaactcagagaccagtgccggcgtgggtcctccgtatgctgagcgccggtcccctgggcccactgttctttctctatactttgtctctgtgtcttatttcttttctcagtctctcatcccacctgacgagaaacacccacaggtgtggaggggctggcccccttcagttgtgaggatcaatatgtatactcatattaaagattgttttttgcttcaggctgtttggaaaacaccaagcgtagaaacttgaaattgtgttctatgaaaaaactggataccaaagccactatcaaggtaggaggtgggacttgactcaagagaccaggctccaacaccagacaaaattaaggactagctaaaacagcaacagggcagaagcagcttttcataagacttacccaccagtatgccatgtcacgtttaccatttccatggtaacacctgggagttattgctgctttccatgacaacaagctgatgacctgaaagttaccacctttttctagaaatttatgcataatccaccccttactttgcatataattaaaagtgggtagaaatatgactgaagggctgcctctgagctgctactctgggcatactgctccacaaggagtagtacctctgctgctgctgtgcactgccacttcaataaaagttgctatcaaaggctgggtgcagtggttcatgcctgtaatcccaacaatttgggaggctgaggcaggcggatcacgaggtcaggagtttgagaccagcctggccaatatggtgaatcaccatctctactaaaaatacaaaaattagactggagaccatcattctcagcaaagtatcacaaggatagaaaaccaaacaccgcatgttctcactcataagtgggagttgaacaatgagaacacacggacacagggaggggaacatcacacattggggcctgtcgggggtgggggactaggggagggatagcattgggagaaatacctaatgtaaatgacgagctcatgggtgcagcaaaccaacatggcacatgtatacctatgtaacgaacctgcacgttatgaacgtgtgccctagaacttaaagtatatttttaaaaaatacaaaaattagctgggcatggtggcgcgtgcctgtagtcccagctacgcaggaggctgaggcaggagaatcacttgaacctgggaggcggaggttgcagtgagctgagatcgcgccactgcactctagcctggaagacagagtaagactccatctcaaaaaaaaaaaagttgctatctaacatcactgtgggacccctgaattcttttgaaatgtaagatgaagtctttttgcaaaatggagttagttatgtcaagagtgctctgtacatgttgcgaactcaaaacagacaactccccattttctctctttttttcccccctgagatggggagtctcaccttgttgcctggagtgcaatgggacgatcttggctcactgcaatctcgtgacccactatgcttggccttaatattttctactatagtttatgctaaatctttttagagaaatccttccccacatcaagatcataaaaatattatcttatatttccttctaacacttttagagttttgctgttcaattcagggttccaggggttagcaaactgctgctcatgagccatatccagtccacagcctgctttgcccttgagctaagattggcttttaatacttttaaagagtaaaataaatagaatatacaacagagatcatatgtagcctgcaaagcctgaatacttactatctggtcttgcaccaaaatagtctgctgacttttatagtctaatacacgaaacattgatttgtgtaggatatgaagtggcacctgtaatcccagctacttgggaggctgaggcaggagaattgcttgaacctgggagacagaggttgcagtgagtggagactgcaccactgcactccagcgtgggcaacaaagtgagactccaactcaaagaaaagaaaaaaaaatcccaaaactccccttaagatgcatataccagcttacctacaatatctttttttttttttttttttttgagacagtcttgctgtcacctaggctggagtgtagtggtgcgatgtcagctcactgcaacctctgcctcctgggttcaagtgattttcctgcctcagcctcccaagtagctgggattacaggtgtgcatcaccacatcctgctaatttttgtatttttattaaagacagggtttcaccatgttggccaggctggtctcgaactcctgaccacaagtgatccactcgcctcggcctccaagagtgctgggattacaggtgtgagccactgcacctggcctgtcttttgaaaataggtggatgatctaactctgttttaaaagcctgattttggctgcaacttgtgtatataaaagacttctcagcaatcttgtgccttggttcccctgaaacaggtacctcacctatatttggtagttggtgatctggagacaaatagtatcctgtgtgactgaaaaagatccctggaatctgtgcctgtgtgtctcagaacatcatcatatttacatgtattttatttcattggattttatttttcatgctgtactgtagcctttgtctttcttggagtcttaggtaagtataacttgtggagtcatgtgagactgttcaacatcttaccctgagtaactgctataattgcagtcacctattttagggaaaaacattgtacttgaaaaggaaacatatttttgtaaaattaatatcaagttcagtgtattttataatttattctcaatttaagaaaaccgtttaggggactttgctgctacattctagagagggattaataaaaacatgtctcacatttggcttatgttgtttcaaagggaaacacatcttgcacaccttgtggctatgaaggaaagagaggcttattttatttgactataggatcaagccacattatctattcatgcaataaaaccaggactgcaaaaattatttaatttccatctctctgatatcagggactatctctcaaactatttagaattcagaagcggcataaaacctgtgaagactcatcttcctcaatccccaagtatttcgttggtttacaagaaacaaaaccctgtataaagatgacggcttctactatatttcatccaatctgagatacctttggttgtatggcacaccacacttttacacaccaagttctccatttaaatatgttaagccacatatataaataagtatgccacacttaaattttagcagtggtaatatgttggaaaaatgtctatcttagaattgatgagataaagttttacccaagagtggcacaacatcttccagacccatttacaaatactagcaaacactacagagataaagataaacagtattgtattgagttttttactgaaacaatgaaccacagcagttctgtggggagtcgaaagcctgagggtcgtgaccaattcagcattccactgcaggctatatgatcaaacagcaaactgtttatcatgaatgcagaatgtgggcaaactcgtatctgcacctgccaccagaaagtatgctgagggcaatcactgcctggcaccatgctccttgaggttatctactgggacatctggagcctactgttcaaagaatgcagtcatgcaggcctgcactaaatcaagcagctgaccgacaaccacccccgctccttgttttctttactcaataaatatgaagtgctatagaagctcaggggccttgttcactagaagcaagaagcccccgaccccttcttccaaacatattcttttgtgtttgtctttattcccacattcatcctcctttgttcagtccagtagggtccgtggcacagatcaattataagttacgtagcattatacaaagattcaatgcagatattctatgggaagtctttatgcacatttaatcatacatactacaaattcacaattgtgatgttaacacatgcagttcccaaatatgagcaatcatttttacaataaaaataggcaaaaacacttaaatatttggtattgttcttatattttttgctttgttttctgacaagcatatttatttacatatttaatacaatactttctataatgctgattatataacaagagcagaaaaaaaatacagatgaaagcatgatttcccagattcattaacatacaaaattacaaatttcttttttcttttccttatttatttatttattttttttttttagacaggctgtcacccaggctggcaaaatcttggctcactgaaacctccacctcttggctcaagtaattctctgcctcagcctcctgagtagcactatctccagctaatttttgtatttttttgtagagatggaaccctatgttgaaaacactggtctcgaactcctaagctcaaacgatccttccaatttggcctcccaaagtgctgagattacaggtgtgagccactgcacctcacctaaagtacagaatttcttccttagtgtcaattatctgaaactgatgtaactgcatattatgccaacaacatccccataatcagtaatacatagatgttccttcctgtgtgttccctctggcttatattcaattgacatttattgaaacaggtattacctcctgactggcatcatgcccagcactattctctgataagaaaggatgtgtaagcttgaaattaaggtttgttcacatttgctgcagccttgaggtttcactcttacattaaccttgtggtataatgagctagtccttctcactgccaactttcagatattcacttcatttatgatttctctcctttgtgtgttttctgatgtagaatgaggctgaatttgcggaagaaggttttccaacactcagtgcattcgtaaggtttctcacctatatgcgttctttgatgtataataagatgtgacttctgggcaaaagatttctgacatttgctgcattcgtggagtttctctcctgtatgtgttttctgatgtcaaaccaagctaaacttgacggggaaagttttcccacattcactgcatccataggatttctctcctgtatggattctctgatgagtagtgagactaaacttacgagagaaagtcttcccgcactcaaggcattcgtaaggcttctctcctgagtgaattctctgatggatcaggagataggacttccggctgaaggctttgtgacattctccacattcctaaggtttctctccagtgtgagaccgctgatgaatattcaggtgtgacttttggctgaaagtcttctgacactgactgcattcatagggtttttcccctgtatgagttctttggtgtaggatgagactaaacttgatggagaacattttcccacattcgttgcatccatagggtttctctcccatatgagttctccagtgagtattgaggaatgactttacactaaagccttttccacattcactgcagtgatacggtttctctcctgtgtgagttctctgatgtctactgagctcagatctctggatgaaggctttcccacattcattacacccatgcgatttttccccggtatggattttttgatgtaaaatgaggttaaacttaagggggaatgttttcccacactcatcacaaccatagggtttctcttctgtgtgagctctctgatggatcatgagctgtgacttattgctgaagcttttctgacatttgctgcatccatagggtttctctccagtatgagttctttgatggaaagtgagttttgacttatcactaaaacctttttgacatgtatgacactcaaagcatttctctcctgtgtgagttcgttgatgtttattaaggcatgacttatcagtaaaagctttcccacatttattgcactcataaggtttctcttctgtatgggttctctcgtgtaaaatgagacaggacttccatctgaaggctgtctgacatctactgcatccatagggcttctctcctctttgtgttctttgatgcttaaagaggtccaacttctgggaaaaggctttcccacagtcactgcagtcatactgtttctctcgtttttgagttttccagtgttttatgagctgtgacttatgactgaaagcctttacacgttcattatattcattgtatttctcttcagcatgaattttctcatgcttaggataaagaaaaactttgtcatatccattacattcaccttcatttcttgcatagcttctgttttgaataaagtactctagattaggattcaggtgtttcccaagtacaaaaggggtatgaaggtttgagctcagatgagatgttatgttgccaaatatatgatatttgtggtgtctgtccatagtttcaaggctgctttggttttctcggtgccattctgtgtgatcattgacttgccaggcatcttctagaaaggagaccaattaatccactgtgatcatgtaataaaaggagtagaagctcacagcaagagccaaggagagaagaggaagtgaaactgtgggtagagaatgaaagtctgagatatttataaatggaagaagaaaaaacagaagaaactatgagaggtatgaaacacatacaaaatgaagataagggaggaaaatttaggaatacttgaaaatagggctatgactatgaattagggggatgaagacagggaaaagcaagtaaactaaagatgccagggagaaagattaaccaggaaagcaagttctgagatgagccagagagggatttgatcagagtacctaaaagaagaacatggattcttttaaaagccaagcaaaagagttctaatatggagcaactaaaaagtggaggcagtattaaggtatgtgaggagcttatgtcagctgttcttagtcacattcacaactttaagaacttcaaaaacatttctccaaacagcatttcagagatgcccccctacttctgttcaactgggatattactttaagttctcctataggactggtttttcacttacctggacaaacctgactctggatttcttcctctagtatccatggttttccttgctccaaccagaataatgtgtctgctttggtaacttgataccctagaaaagtatcaaggaaaattataaaggacacatgaatgcaaatactagggctacaagacttctgaaaaatgatgaagattacttttttttttttttttgagatggagtctcactctgtcaccaggctggagtgaagtggtgtgatcttagctcactgcaacctctacctcccgggttcaagtgattctcctgcctcagcctcccaagtagctgggactacaggtgtgcgccaccacacccagctaatatttgtatttttagtacagacggggtttcaccatgttggccaggatggtctcaatctcttaacctcatgatccacccctcttggcctcccaaagtgctgggattataggcatgagccaccatgcctggccgaagattacatttaaggggttaaataatttgcatctgggccaagtaaaggccttaacgtccattggaaatgagagaaaaacactctgttagaggccagaaaagtactaaaaatctatgatgtattaaactgaagtctaaaaaaagtaaagtatttgtgaggccccacgctttttaattactcagaaaggaagggcaattgattgcctacactacccaggaaaactgtgcttacccagtgataccaggttgctataattttccaacatcacgtcttggtacagattcttctgaacagggtccagtagctgccattcttcccaggtgaaacccacagctacatccttgaatgacagtgagccctgtaatagaacattcctactcaattctaaaggattaccattgtgtaatgctatgaacataaatgataatttcttataatacattttcccagagtaagttatttggctgccttccatgtaactagttttgccttataatatataggaaaaatgttttagttaaaatatcctatttcggtacttccattcattcactgattcacatatttaattattcattcacaaaagagaaacagaacctccttacatcctttaataaaatatttaatctgcaacagcagtccccaactttttcggcaccagggactcgttttgtggaagacaatttttccacatactggggcaaggggatggttttggaatgattcaagtgcattacattaattgtgtactttatttctattattattacattgtaatatataatgaaataattatacaactcaccataatgtagaatcagtggtagtcctgagcttgttttcctgaaactagatggttccagctgggggtgatgggagacagtgacagatcatcagacatcagagtctcataaggagtgtgcaacctagatccctcgcatgtgcagttcataacaggattttcactcctagaagaatctaatgctgcctctcatctgacaggaaggggagctcaggcagttatgtgtatgatagggagtggctgtaaatacagataaagcttgctcactgacctggtccacttcctaacaggccacagaccagtggcaggggttgggaagccctgttctagagaatcattgagcctgagggtgggcaagggacactcaactaaaattcactcaaattcacatttagatatgtcaatgctgatacaggaaaccataagaatacacaaaaatgtttcaagattgattattttaaagatggtgaaaaaggattaagagggaactttcaggttttgcactataaaattctatattgtttgaaagtttgacactgcaaatttttttttaattcattcaagttggagaagtattataatgatgatgattttgtttagagacagggtattgctctgttacccaggctggaaggcagtggcatgatcacagctcactgcagccttgacctcctaggctcaagcaatcctcccacctcagcctcctgagtagctggaactacaggtgtgtgccaccgtgctcagctaacttttgtatttttttgtagagacagggtcttactatgttgcccaggctggtctcaaattcctgggctcaagtgatcttcccacctcagcctcctaaagtgctgggattacaagtgtgagccaccatcgcccagctcacattgtgaatattttaagcttcatttatataactggaattttaaaaaaataagtagataagtattggctttgaacagagagctaacactgcattcttgggtgtgaagagattatgaagggaaactctaagactctgtcaacataacttggaactgtttactaatcaatgtaaataggagtttctctacctcagcactacaggttgagcatccctgcttcaaaattctgaaacctataatgctccaaaatctgaaattctttttagggctgaggtgatgcacaaaggtcatgcttgaaggaaatgcttaccaggacatttcaaatgttggattttcagattagggatgctcaactagtaagtataagtaagtaagtaagcaagcattctgaaaaaaaaaaaaatctaaaatctgaaacacttccagtcccaagcatttctgataggggatgctcaatctgcatttgttggaggccgagaaaatgggggttgtgaccaacccagtataccactggaggctatatgagcaaacagaaaactgttctcatgaaagcaggatgttggaaaactgacaaattgcatctgccaccagaaggagtgccaagagcagtcacaccccaggcagagtgttccttgtggtttgtagggagccaaaggcccatgggacatgatcagctcagcattccactggaagctacatgatcaaacagcaaactgtttatcacaaatgcaggatatgggcaaactcacgactgtgcctgctgacagaaagtttgctggcggctatcattccctggcgctgaggttatctgctgggacatctagagcctgttgtttgaggaatgcaatcttgcaagcctactctggaccaaccaactgaccccttcttccacaccccttctcactatcccttttgcctaataaatacaaagggctgtgtaaagctcagagcctttgtccactagaggcaaggtgctccttgaccccttcttccaaatatactcttttgtctcgtcttttattcccgcatttgccccactttgttcagcccaccagggattgtggcaggttacatagtggccccccccaaacagtgacagaatcgagtgctccacagtggttatctataggaacatctgaagcctgttgtataaagaaagtaattatgtgtacctctaatgaatcaaagcagctgaccaaccgttacctctctctccctattgattctacctaatacatatgaagggctgtagaagctgagggctgtctttgctcactagaagcaaggagtcccctgaccccttcttttaaaatgtatctttttgtctttgtcttcacttctgcatttgtcccatttcgttcaatcccataggaacagactgtaacaggcattgacattttggtttggagaattctttattttggggcactgtagtgtcattgtaggatgcttagcagcattcttagcctctatccactagctccaattagcacaccctcctttcccaggtgtgacaatcaaaaatttctccagacattgccaaatgtcacctggggtcaaaaaatgaaaaccactgataaaaaaaaaagcagaatattgaggactctttgtggaagaccatatgatggtcatagaatccatccatcttaaaaatctctacattttatccctgaataaaaacagacccccaggaggctgtggactttggctacactgttctgggtccctgaagcactctgatcactgagtttggttttggtattacaccactggcttatctgtgggggcactaacttctatatgatctatatcatgacccatcaaagaaatttcttcttaagtaacatgaaatattcacttttctagaggagctttctcctcagggaaaaggaaacgatttgttattgtgtccatgtggtagactgcatttcccaaagatgaccacaataatatctcacattccaaagaaaaccttctgctaaatcttgccactcccacacgaagagatggagcctattcccttcccccttgaacctagctagtcttggtgatttgcttgtacctgcagaatacaacagaggtgacacaacataacttccgaggctaaggcagaaaagcatgggggaaagaatgagagatcagactattactgcatctatgtagaaaaaggaagacaaaagaaactccattttgatctgtactaagagaaattattctgccttgagatgctgttaatctgtaaccctagccccaaccctatgcttgcagaaacatgtattgtattgactcaaggtttaatggacttagggctgtgcaggatgtgccttggtaaaaatgtgtttgcaggcagtatgcttggtaaaagtcatggccattctccagtctcgagtacccagggacacaatgcactgcagaaagccacagggatctctgcccaagaaagcctgtgtattgtccaaggtttctctccactgagacagcctgagatatggcctcatggaaagagaaagaccagactgtcccccagcctgacacccataaagggtctgtgctgaggaggattagtgaaagaggaagacctctttgcagttgagataagaggaaggtatctctctcctgctcatccctgggaatggaatgtgtcagtgtaaaacccgatcgtacattctatttactgagataggagaaaactgccttatggctggaggtgagacatggtgggggcaatactgtctttacttcactgagatgtttgtgtaaagtcaaagataaatctggcctatgtgcatatcaaggcacagcacctttccttaaacttatttataacacagagtcctttgctcacgttttcctgctgaccctcttcccaccattaccctatagtcctcccacatccccctcaccgagatagtagagatagtaatcaataaatactgagggaactcagagaccagtgttggtgcgggtcctccgtatgttgagtgccggttccctgggcccacttttcttcctcgatagtttgtctctgtgtcttatttcttttctcagtctctcgtctccaccttgtgagaaatacccacaggtgtggaggggcaggcctccttcatctggcacccaacatggggcacgaacccatgaccctgagattaagagtctcatgctctaccgactgagctagctgcagaatgcaacagaggtgacacaacataacttctgaggctaaggcagaaaaggccctgtggccgcatcttggctgtctcagagccagcatcatgctgtgagaagcccatccatgtcacatgtggaggtcacacacaggtgctctggctggcagcctccttgagcctagttttcaagtaatcccagcctggcacacagatacagagaggaagaagccttcagatgattccagtccccaaccttctgagtcttccagttgagattcaagacatcatggtgtgaagacaagctgtgcagtaaaggataaacagagcgagtctgggttacccagaaactgaacattccaaagaaaggctcagcccttccctatacctggcaggtaacttctaaaccaagcttgtccaacctgcggaccatggggtgcacatggcccaggagggctttgttttgttgttgttggtggtggtgcacacagcccaggagggctttgttttgttgttgttgttgttgtttttgttgtttgagatggagtttcactctgttgcccaggctggagtgcaggggcacaatctcagctcactgcaacctccaactctcaagttcaagcgattctcccacattcgagcaattctcctacttcagcctcccaagtagctgagattacaggcatgtgccaccatgcccagatagttttttgtatttttagtagagacggggtttcaccatattggcaagcctggtctggaactactgacctcaagtgatctgcccacttcagcctcccaaagtgctgggattacaggcataagccactgtgcctggcctccaggagggctttgaatgcaaaacaaatttgtaaactttcttaaaacattatgagattttttgagttttttttcttttttctttaagctcatcagctattgttagtgttagtatattttatgtgtggcccaagacaattcttcttccagtgtggcccagggaagccaaaagactgcacactcctactctaagccgttggaatatattgtccgatgagggtctttgtttactgggagccttgggtcacacaagatcgtctatgctaacaatgtatgatggaagccttgggccacactgtagttatggtggcctctgaaagggctgaagaataaggtcagccactcatgtgctcagcctcacccatataactaaagccaaataaaaaccctggacacccaggctcaagtgggcttcctgtactggcaatacatcatgcctgtcgtcacacatcatggctaggacaatcaaacattgtccatatgactccacagagagaggaaaactcaaagcttctgcacagcatctcccaaaccctgccctacacacctttctctgtttctgattttaactgtatccagtctatgtaataaaataaaatcatgaatatgacagttttgctgagctctgtgttattctaacaaattattgaacctgaggaaccccagatcttgcgatccccagaacatacaagccatcaccatgtctcacttcctgactcagtgaatccatgcagatcataaaagtaaattcacatctctaggtcttgggctggcttgctatatagcaacagattacttggaatagggaaacagtcataacaacattttagtccatgatgggttgcacacacaatggtggtcccttaagattataatggagctgccaacaaacatatgaaaaaaagcttatcatcactggtcattagagaaatgcaaatcaaaaccacaatgagataccatctcatgccagttagaatggcaatcatcaaaaagtcaggaaacaacagatgctggagaggatgtggagaaataggagcactttaacactgttggtgggagtgtaaattagttcaaccatgtggaagacagtgtagcaattcctcaaggatctagaactagaaataccatttgacccagcaatcccattactgggtatatacccaaaggattacgaatcattctactataaagactcatgcacacatatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatggatgaagctggaaaccatcactctcagcaaactaacacaggaacagaaaaccaaacagcacatgttcttactcataagtggcagttgaacagtgagaacatatggacaaagggaggggaacatcacacaccggggcctgttgggggttgtggggctagggaagggatagcattaggagaaatacctaatgttggtgatgggttgatgggtgcagcaaaacaccatggcacatgtatacctatgtaacaaaactgcacgttctgcacatgtaccccagaacttaaagtatatattaaaaaaaaagattataatggagctgaaaaattcctgccatctagagacgtggtagccatctcaaggtagtagcatgtgttactcagttgtcagtgatgatgctggtgtagacaaacctactgctcttccagtcatataaaatacaacacataaaatatggatagtatgtaattcttgttaatgatatacatgactatgttaccagtgtaggggaaagaaagatagatcagactgctactgtgtctatgtagaaagaagtagacataagaaactccattttgttctgtactaagaaaaattcttctgccttgagatgctgttaatctgtaaccctagccccaaccctgtgctcacagaaacatgtgctgtgtcgactcatgtccaaggtctaatggatttagggctgtgcaggctgtgctttgttaaaaagtgtttgcaggcagtatgcttggtaaaagtcatcaccattctccagtctcgagtacccagggacacaatgcattgcagaaggccacaaggacctctgcccaagaaagcctgggtattgtccaaagtttctccctgctgagacagcctgagatatggactcatgggaagggaaagacctgactatcccccaacacaacacccataaagagtctgtgcctaggaagattagtaaaagaggaaggcctctttgcagttaagataagaagagggcatctgtctcctgctcatccctgggaatggaatgtctcagtttaaaacccaattgtacattctatttactgagataggagaaaactgccttatggctggaggtgagacatgctggcagcaatactgctctatactacactgagatgcttgtgtaaagtcaaacataaatctggcctacgtgcacatcaaggcacagcacctttccttatttatgacacagagaactttgttcacatattttcctgctgaccctctccccaccattaccctatagtcctgccacatccccctcaccgagatggtagagatagtgatcaatgaatactgaggaaactcagagaccagtgctggcaggagtccttcgtatgctgagtgctggtcccctgggcccactgttctttctctatactttgtcagtgtgtcttatttcttttctcagtctctcatcccaccagatgagaaatacccacaggtgtggagaggctggcccccttcataaggttgttgagatttatctatgttggtgcatgcatctatgatttgttttttattattgttcagtagtattccagggtatgattacactgcaatttgcttatacattcatgtactgatggacacttggactgtttcctgttcagggtattatgcataaaggtgctaagaacattcttgtgagtctttgtgaggacatatcatttcattactgttgtataagtatctaggagtggaattcctgagtcataagattcttgcttttattttgcaattctcctaaggagtcatatagttctgtaaagcttttcactcttcacagatttgatattttaagtaacacggtatgtttctgaaatggagtttgcattttggggcattttctatagatgtatcatgaaggacacgtgaaaactctgttataaatataaacactccactgcatgcaggaatttccttctcattcttccaatggaattgtcttaatttaggttggatcagaattagaatttacgttatgatgactatgtaaataatatttataggtcagtcaggtagtatcctatgattacttttcttgcacaacttttttttttcttttttctttttttcctcatgaaggggttgccaaggctgtgtagtgcagtggctattgataggtgcgatcatagctcactgcagcctggaactcctgggctcaagcgatcttcctgccttggtctccccagtagctgggactacacgtgtgcgccatcgcgcccgggcttgcacaacttttcattctcccagagtcgccttatttattccttccagaattttaggcacttggttctccgaaagccccgacgttaagattgactccacctacagcagagggaaggcccttcttctctcttaaggaaaattcccgcctcccgcattggattccttttccggttggctggtggctgctctctttacctgcactgggcggtgaccgtgtccctcaaatgtaaatgaggttccaggggtcgctgttttttcactttccgttgacggggtgaacaatatcctcgtacctcgattgcctctccacacccttttggtcctcaaaaatcttcctcttgtcctccacatgtagctagatgcgttttcgcggtatatgactcagggtgcgattgctctttttcctctgtggagaaagcgttttcacttgtacggacacctaagtgttaagatggccgcgcccattgtgtcattcccgtcattctttgtgcaaagcggatgacttttctccccagcccgctaaggtgcacgtagccataccatgtttgtcttggctaagctcgaccctctgaaaataaatgaaacttgggcgcaggatttaggtgccaaaatatggagttcttcaccgtcccgcgctatccctgaatacttgggcagaaaaggtccactttaccttccgtacgtgcaggattcaaagatggctgcctccagtatccgtgacgagaggacgcgaacttactacctcccagtcgtccgtgctccgtacacctgcaacttcagaccttcctcggccgccgtaggccggcttggaggctgggggagggcccagaagtggaataattcaggaaagtgcaggttctgggaagtctcggtgggttccccgcaaaatcaggtctgtgtgtgggtctgtctgtcaggatgaggggaggagggtgtctgtgggcgtccgtttagtgcggagccgtggagtttgtgggggaagcgggagcaagtgggagtcggggtattggggttggggcgtctccggagtcagccctgagggatcccagtggtcggtggtcagagtctgtccagagcaacacttggaagtccgtgatcagggtttggtgcctttgcgggtcactctgtagggctcggtgattgaggactggagtgaggagtggtttttgtcaaggaaaactgtgtctgcttcggattcggggttttattttttatttttgagacagggtctcgctctgtcacacaggcttgagtgcagtggcgcaatcgtggctcactgcagcctccatctcccggggctcaggtgattttcccacctcagctttcccgagtagctgggactacaggtgagcgccaccacgctatctatctatctatctatctatctaatctgtctaatctaatctatctatctatctatctatctatctaatttatctatctaatctatctgtttattgcagagacgggggtctcactatgttgcccaggctggtctccaactcctggcctcaaacgatcctctcaccttggcctcccaaagtgctgggattacgggcgtgagccttcgctccaggctgtaatcaggatttaatatgcgactcagtgaggaggagcccgggttcatgtgaacctaggtgtgtggtccaggtttttggattaatctaagggggtgtgaccatgttagggaggtctagatgtgacagtcgtggagaagcttgtgaaggctgaagccttggcagccagggcatcctgattggtgtgtgtgttcaggtccaacggtacattccctctcagtcccttttaagtttctctgcaaggactggtttacaaatctcatttgacttctcacatctctcctttctctcatcctggtaaataggaaagctttggggaagatcaaagattaatcaaatctaaaatggtaaggtggcctggcgcggtggctcacgcctatattcccagcatttgggaggccaaagtgggcgaattgctcgagcctagaagttggagatcagcctgaacaacatagcctgtctctccaaaaaatacaaatattaactgggtgtggtaacacacgcctgtagtctcagctactcgggaggctgaggtgggacgatcacgtgaccccgggagttctaggctgcagtgaactatgattgagcactgcactccagcctgggcaacagagtgagaccctgcctcaaaaaaaaaaaaaaaagaaaagaaaaggagaaaagaaaaaggaaaaaacaaaacgaagaaaatgataaggtttctattaaagattttcgttcttcttcctcaggtttactgtgtgaatgtgtgtatacacacacgtaaatattttctttcaggttctgacacaagtaaaacatctctcttatcccaaaatgtgttccccagtaatgacttttgataagatttttgtatatttcaatttcagttttctatgcttgattttcacaatgcagataagctgctgaaacattggtataatttgccgtatttaattttacattatgaacgttcttatagtaaacatatcatccatgtttttgtttaaaaatttttttttaagatttctgtaatagtataccatcaagaggcaaaactgcaccactgtgacttgaatcactaagtgtatggatatatttagatagaattttaagacttaaaaagttcacttatcacttttaagaatgggttacaattctatgtttacccaaacatgtttctccctgaccctcatcagcaccttagtttttaatttttttgcaattgtaaatggtgtgtttttaattttgacctttctgttctcttctaatttactcttacatagaagagcaattagtttagaaaatatttacattgtttttggtcaccttactgaacaaacttccctgttctccaggttacaaaaactttcaaacatataacatgatttaaagaactttacaattgaatacctgtttgcctaccatctggattttatcatcattttattgtgtttcttttattacatatctatctatatatcatccttctactcatcattaatccacctttttttctttttatagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagtaagttgcagacattcatacatttgcccctgaatatttcagtaggtttatcataattaagttctactgacagcttttcctaattacaggtctattagtcccatactgtataattcagtggcttttactatgtgcggccatcaccaaagtcaactttagaacattttcatcacttaaaaagaaaccctgtacccttttgttaccactccctatgccctaccactaagtaatctctaatctactttctgtctctatagatttgcttattttgacctttctgttttcttctaatttactcttatttcatttcatgtaaacgctacaatataatatgtgatcttttgtgactggtttctttcacatagcataatttttttttttttgagacagagtcttactctgtcacccaggctagaatgcagtggcgtgatctcagctcactgcaaccaccacctcccaagttcaagtgattctcctgcctcagcctcccaagtagctgagattacaggtgcctgctaccatgcatggctaatttttgtatttttggtagagacggggttttgccacgttggccaggctggtctcaaactcctgacctcagctgatccgcccacctcagcctcccaaagtgctgagattacaggcgtgagccactgcgcccagccaacatagtataatgttttcaaggtttgtctgtgtcgtagcatgtatctgtacttcattcttttttatgccagaatagtatttcatggtatggatatggcatcttgtatttatcctttcatcagttgatggacttttgggttatttcccctttttggctattataaataatatgctataaacatttgtgtgtaagtttttattgtttttatttctcttatatataagcctagaaatggagttgttgggttatatggtatgtttagccatttgagggactaccagacttttccaaagtggctgcaccatttaacatttccgccagcgatatttgagggtgtccattgccaccatgtacctaccaacacttgttatttttagttttttattacaggcattctagtgggtgttaggtggtttctcatggttttgatttgcatttctctggagacttatgttgagccatttttcatgtacttatgatatacataactgaggtacatgtatttttactaaatatggaattgttagtatttttaatagctagatagctccatttctggatgtgtgtacttctaatcagccagttaatcctgttaatagacctaaatcctttacgtcaactttgcatgcatgtgtcgctatttcctttacaaaaatttccaaggtggatttttgggttctagtaatatctcaaatggaagtattcaatgcaaagtgttatttccaaaattgtttagtcacttaatactgataaaaaagtatgtctattttggaatgcttgcaacttttagatataaaatcatcaatctgactaaaaacttattttttgtatatgttcaattgaatctataaaactgtcactcttccttagtcatataatttatttcctcttctctaatattgattatttatacttgattctttatcaaactaactgggtagcctttccagaatagttaaaatagtgataatcatcctgttcatcttcgatattgctcttgactttagagaatgtacttttatagtttcatagaacttttttttcttcattcctagaacttctgtaggatgtatttaattttttaaaatgaggtaaaattcacaagacataaaattaatcattttaaagtcaacagtgcaatcgttcttagtacagtcacagtgttgtacaaccaccacttgcagccacttcacattctcccctccagtagaccctggcaaccaactatgtgctttccgtctctttttgtagagtgcccgattctgtcgctgtttggggcgccagttgtaactgaccatgattcctggtagactgaacaaagcggggcaaacgagggaataaaagacaaaaacaaaagagtatatttggaagaaggggtcagggggcaccttgcctctagtggataagggctctgagctttacacagctctccgtatttattaggcaaaagagatagagagaagggggggtgattgtcgagtaattgtcagtcggccttttggttcacagcaggcttgtgagattgcattccttgagcaatagcctctagatgtccccatagatagcctccaggagcccagcgccagggaatggtggccctcagcaaagctggggcaggtacagaagcgagtttgcccacattctgtactcgtgataaacagtttgctgtttgatcatgtactctccagtggaatgctgagttggtcacgatccctttggccttttcggctcccaacatcttttttttttttttttttttttttgagacagagtttcactcttgttgccctggctagagtgcaatggcttgatctcagctcactgcagcctctgcctcccgggttcaagcaattctcctgcctctgctaggattacgggcatgcgccaccatgcctggctaattttgtattttttgtagagaccgggtttctccatgttggtcgggctagtctcgaactcccgatctcaggtgatctgcccgcctcggcctcccaaagtcctgggattacaggcgtgagccaccgcaccaggccagtgtgctgtctgtatgcatttacctaatctgggtattttatataaatgaaatcatataacgtgacatttagtgtctgacattttctttttttttttgagacagggtctcactctattgcccaggctggagcgcattggcacactcttggctcactgcaaactctgcctcctgggctcaagcaattctcatacctcagccaccctaacagctgggattataggcatgcaccaccatgcctggctaatttttgaactttttgtagagatggggtttcctcatgttgccctggctggtcaagagtttatcttgagctcaaagcaatcctcctgccttggcctcccaaagtgctaggattacaggtgtgagccaccacgcctgagtgtctgacattttcacttagcataatgtttttgtggttgtggattgtgtgctgggctactcctttaatgattagccagggaatctataaacctgccttaccgttcacttcctgcttgcactgaacctgtagacatcagccagaaggaacgttttagagtcttcttaggtcttttctcagccaacatcctcccctgtgcatgcgtgtggcttttatatattcctcagtctatacgagtgcttttgaatggtataatttcctcaagacactttcctcctacctttttctcacaacctttcctctgtgactcaagtgtaatcttttgccccaggcagctgaaggttgttgttctgcttcacaaagtgtttgagaaatgcccattacttttcctccctgagtgaattccaaaacaggaaggggcctgttgcataggtccttcaggtagttagaatagacaacaaacaatttttttatttttatttttgagacagggtctcactctgtcacctaggctggagtacagtgacgagatcatggctcaccacagactcaaactcctgggctcaagtgatcctcccacctcagcctcccaaagtgctggtattacaggcatgagccactgcactcagctaaacaaaattatttgtgaataaagtctattctgttccctccagggcctgaatccaggttcccacgttgggaatgttggccacaatctttaagaccatcactgagctggggagggggtggagcaaagacagataaaaatggcacagaactttcctactatttttaagtcaccattttgttgttgttgttcttgtttgttttgtttctttgagatggagtctagctctgtcacccagactggagtgcagtggtgtgatctcagctcactgcaacctccacctgccaggttcaaatgattctcctgcctcagcctcttgagtagctgggactacagacatgtgccaccacacctggctactttttgtagttttagtagagatggggtttcaccatgttggcctggctggtcttgaacttctggcctcaagtgatcctctggcctcagcctcccaaagtgctgggattataggcaagcatgagccaccatgcccggccagtcaccttttttttgactcaatatttgttctgttgttgtaaacctttgactatttttcagagttctgaccaagtttttgttttttgattgtttttacttgattttttgatagtttttttacttgagtttttgatttttcgatagagggacggacccttggacctacctactctgccatttttactcaatgagattttcctccacagtatatatgcttttgttttttttgttgttggtacttttaaaaaagaaataaactgatgcaagtgcaccttcagtgatatcctctaatccaccccctttcctctcctccatccctagggataactattcccttgaactaatttcatataatgcatgttttattaaatgtgtacatattgaaaaataatacatagtcttattttatgttttttaattttttaaatatacttttctttgttgtttctttcatatgatgatgatttgtgaacacgtcctgtttggtagtgatgctttagaatttatggaaattttctttatggcttcctatacatacatgagttttcaggaaatatactcctccagggaaaggacttagccactggagcaaacaggcgtgattacattctccagaaagctcataagggtcaaaaatgaagtagaagctcttcagctattcctgggaaaggggctgtggaagctcatgggaaaggaagccttgctgtttgaaatacacaccctggatgtcactgaaatgttgcatccaccacctcctgcccaggaatgttagatcatttgggttctgcacctttccactagtggcgttctaagaagaaaagtgtgaaacatctcttgccacaattacgtgcttctgagattgcagagggaaggggagcatttgcagctgtgggttaaaggatgagtcagtgcagaccctgtgggtttggagcatgcaggagggccaccgggagcttgtcacaatgattccacccaggtggaaggaaagcttagggtgactccatccagttgatgctctcaccatgtgagcctcttacttgagttttagaattgggcataaaaaaagcctctggggccgccactctctgacctgctgctttcaggccaagggtgtagcgtgcagtttttccatttgtctttgtgcctgtgtcactgttggcagtgctgatttcagaaggtcagattatatgtctatgacagtggccatcttccatgatgaatgaaactccctcaaggtagtagcaaagagagctaagatgtatgatgatggtatgcagtccaaaggtattcagcagaggctaaggtcatgttcttggagacaggctgtgtgggttcagattctacttctgcttttggacaatatagtcaaatctgtaagccttaggtcaatgttggaatgggaaataatgattgatactttataaggatgtaacgcagaaggtagtaatgagaattcaaatacaacaacccctctgcttggcttaatacatttgtcttcaaactgaggcatgcctacatgtgaggtgtatgatgacttttgaccaggcatgtggacacacgtggttttaaagaaataaatatccaattcctcaccttctctgtcctttttctaaaacctgatctaagaagtttcttggtgttgcagcatcatgttggtgctggttctcctttcccatctcccctctcacagtcacctcacttacatttcacagaagaaagacagtttgtaaatgtattggccatacctgtagaatcttatgttttgttgctccaggatttgttgttgccccagggtgggttaaaacttctggggccccaaataaagggacagttagagatggccttgcattaaggtgagaacacagcagcagtgacagcacctgggcctgcagggaatgtacactcaaatcaatttactcttcagcccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggtgactttttgtttgttttagtctttccttcatcacatgattgatttctggaagactttaaaagtcagttgaattaagtcaaaaagtataatttggtaaactaggatttgtgcatcagtaaatttagattgtaatttcaacatctaggcaaagtaggatcaggactatattgtttacatgtggtatcatagaaagatacttggtctttgtctggcatagagctcctaaaacccttggaatttcctgaatgataagggtcttttttttgtttgagacagggtctcactttgtcacccaggctggagtgcagtggtgcaatcttggctcactgcaacctcggcctcctgggctcaagcgatcatcccatctcagcctcctaactagctgggagtgtgtgccaccaggcccagctaactttttgtatttttttgtagagatggggtttcaccatgttgcacaggctggtctctaactcctgagctgaagcaatctgtctcccttggcctcccaaagttctgggactacagttgtgagccactatgcctggtcctctttttttgtagtgaaactactctcagtggacccctaggtagcttcagtatggaggctggttgccagaaataacaagccttgattagaagcttggaactttcagtactacctctaatctccagggagcagagagaggctggagattgagttcagtcaccagtggccaatgatttattcaaccatgcctgtgtaacataaaaacccctaaacagcagggtttggagagctgggttggtaaacacattgaggtgctgggaggttggtgtgtgcagagagagcatggaaatttatgcccatacaccaccatactgtgccctgtgcagcttttccattgggttattcctgggttgtaaataaaccagtaatagtaaagtgctttcctgagctctgtgagttgttctagtagattattgaacctcaaggtgggttgcagaaatccccacatttgtagccaagggacaaaagtctttgtaacctggggacctcacacttgtgactggtgtctgaagtgaggttggtcttgtgggattgaaaccttaacctatgggtcttccaggagttggtgtcagaattgaatctaatcgttggacacctattgggtgttagagaattggagaattggttgatgtgagcaaaaacccacacatttggtgtcagaaatgtgagtaaaaacagcacaatggaattcacacaaaatgactaatgttggaacctaatgtgtgaccggagcatcctgtgggttatagtagctgtcaccttctgtctaatgtctctgactgtcatcacatccagagagtccttggtcacaggatatgcactgactctcaggagaaagcagaccagttcccgagaggtgtcactattaaatgcacttaggtcccaggacagtttttagatggttcttcctagaggtggtgtgacagatgatgtcttttttcttttttttttttttttttttttgagatagagtctcactctgtcatccagattggagtgcagtagtgccatcttggcctaccacaacctctgcctcccaggctgaagtgattctcctgcctcagcctcccgagtagctgagattacaggcatgcactacgactgcccggctaatttttgtatttttagtagagacagggtttcaccatgttggccaggctggtcttgaactcctgacctcaaatgatcctcccacctcggcctcccaaagtgttgagattacaggcatgagccaccacgcctggccccgaatataaatgccataagcccagccttctcatacatgccaaagcacaggtcctcagagacctttttgggaagaggccaaaggaactcagaggacacagttcaggggtccaaggcaaggttacccaaggacccagtcttatggctggtagggtcatccaggaataaaacctgaaaggctgaggaaaatggaaagattgcacaactttctttttttattctttttctaaatttttttttcatttttcttctttttcttttcttttgagtttcacattgtcacccaggctggagtgcagtggtgtgaacatggctcactgcaacctcgatttcctgggctcaagagatccttctgcttcagcccctcaagtagctaggcatgtgccaccacatccagctgatggttgtattttttgtagagatggggttttgccatgttgcccaggctgggattgcatgactttctaaggttctctgtatgaacaggtggctgacttactgtttgagacaggattggcagtagggagttgaaagtactgttgtctggtaagggaatgggttgttgggatccagagggtttgctttacaacatccccctgtgtaagattgtgcacattctttttccatgttcaaagccagttcttacaccctcatcctttaatacgttaaaaaaagtaagtatataaatgtacatggatatatatatatatatatatatatatgtgcaatatgctgtataggtttatagtctgggagcaataggctataccgtagagcctgggcatgtagtaggctgtatcatctaggtttaagtaagtgcactctgtgatggatgaacaacagaattgcctaatgatgcatttctcagaatgtatccttgttattaaatgacacatgaataaataaatatacatgtatacatgtttgcatatatttgtatgtatgtatatatatgtatatatatttacagacgtatctgccttagcccttagatctttggatagtacctttccattattgtattttctctttcacaaactaaattggtacatgctagaccttacctatcctctgtatttattaatctggtcttttatatattgcatcattctgtccttttgttgcatttttggtagttttttcagatctacttaccagttcattgactatctcttcagttatgctgcttacacgcctgataacataaatataaatacttcaaaacccatatgtgtgtgtatggtttttgaataatattttgtattttcttttttattatttatttatttattttatttttatttatgtatttattttgagatgaagtctcgctctgtcactcaggctggagtacagtagcatgatcttggctcactgcaacctttgcctcctgggttcaagtgattctcctgcctcagtctcccgagtagctgggattacaggcatgcaccaccatgcctggctaatttttgtatttttagtaaagatagggatttcaccatgttgggcaagctggtctcaaactcctgacctcaggtgatccgcccgcctaggcctcccaaagtgctgggattacaggtgtgagccaccatgcctggcctatttatttattttgtaagccagtcacatttagcagtagggggtaataatacttaattgtctcttgttctttggacatgttttggaaagagtcttttactcctcctaacatataaaatatacttatttattatgtagtatcttgtagtgtttggggtttcttcctggttgattctggtagcgcacatgaagattcattgaagattcatgatgaataaagaagtatgctttattcatcctgatattgctaaaatatatttagtgcctggcaaataggtgctcaaaaaaaaaaagaggattagcaagaggattaaatgattggttcttatagaaacttctgatttgttaaatgatagataattacacaattacagaatattttgctagagatagattttgaatatagatagattttggagatggatttttgcctctatgacaatgtatttttttaaaaatcacagcacctagatatatagatgcagactatttggtaaaaatgagcagaacaatgttcttcacatttcttccatataaatgagagaaatacttcatattaagcaggactctcttattacaggaatcactgaccctggaggatgtggctgtggagttcacttgggaggagtggcagctcctcggccctgctcagaaggacctgtaccgagacgtgatgttggagaactatagcaacctcgtgtcagtgggtgaggacagctgccctgtgtcactcagagagtacccagtcaaaggcctttgctttctcagctttcaaaagctctggagggcctgtggtgctctgaagtggtagattctgtaccctctctggccccagataaaagagtgtaatgtgccccctttagagggaaaatccctttgctttgcagacacataaattacatagttcctaaaacagaacatggtcccatgttgatagaccacagctcaattcaatgagcctaagttgtgtatcatttcctatgaacagggtatcaagccagcaaaccagatgcactcttcaagttggaacaaggagagccatggacagtagaaaatgaaatccacagccaaatctgtccaggtgagttcagggtgagagccagcaaggagggtggctgagcaagtcacatgatagttgttcagcagtgtctgagctgtcagggcatctgaggctgtgtggacagagcctccatgtatccctctccccacacaaaagctctttctccttcgggtatttagaggaacatctgcttcgttatcgcgtcttggatttcatcactgtttattttttatttattttattttatttatttattttttgagatggagtctcactctgtcacccaggctagagcccagtggtgcaatcttggctcactgcatcctctacctcccagttcaagcgattctcctgcctctgtcttcccagtagctgggatcacaggcacccgccactacgcccagctaatttttttgtattttcagtggagacggggtttcaccaagttgaccaagatggtctcaaactcctgacctctggtgatccacctgctttggcctcccaaagtgctgggattacaggtgtgagccaccacacccggcctcatcactctttatttaatctaggtttgatttgtttttctcaaggtttcttcctttttaggattctcaaatctcatcatttcttgttcccccatcagagcatcactacctgttccttctacttctcttgctatgaaattcctccttccatgtctgtctccaaagagtggtcttggatatcagcactctctcctgaccactatacctttctgcccctttagataatgttgattttttttttccaaaggtcttcccaccctatcttggactctgtgcccccttagtaacctggtctgttgctttgcatatatttgcttccttagcttctcttttttctcccactctgaggtcctccagaggttctgtttcccatttattttgctctgttctcatatcctttaaaagtttccttcattctaatgacttaagttcttgttctctatggagattctcagattgacatctcccttaatatttcctaacttacatgtttgtacctattttttacccacttgcatgtcaactccttgagtcgatcctggccaccacagggttaccttgaaacttccctgcctcctcagctaccgtatttaaagtctttgctctttcaattgatttttgaagtagtctcattctctttccaacccaaaccagattactacacctcatgcctgctttgcttcaatttccttttggaatcattaattctgcctattatttagtttctcttaaattatattgctggacttattcccttaaagcttttctgttcttaccatagtctgatggcactgagtcccagtgaatcatagcagtcatataagatggaaatttctcatctgtcaggtgatattctagttgaatcaccatgatatggtatcatcttgcctacacagagtttgttttccttttccttttcataaattcaaagccaactatatataaagcactacatttgaagtagtttccgcagtgtgtcccttactttccttgtttcattgccttaaatattttttgatagactattacatatgggccctgacagctgtgaacatcaataacaacaacaaaattcttcttggagattacctgctaaaaggaagaggcacaaaattaatcaaaatggataaatgtcttgtggtgaaaaatgctgggaagaccaataacaaagtataatgagggatgccgggagtgggaatggctgtttggtcagatgcctttgagcagctgtatgacagacatgaatacgtccccctggtgaattaccttccaagtagacaaaatagcaggtccaaaggcccaaggcaggtgtgtgtttgaggaacttcaaggaagcctgtgtgaatacagaggagtgaacaagaggggcagtggtcggagataatacggaagtaaggacagtgtggtgggatctggagtttggggtagacaggtcatgtatgacctttcaaggacattttaatgacttgatttttttttttttttttggcacagagtctctctctgtctccaggctggagtgcagtgctgtgatctcagctcactgcaacctctgcctccctggttcaagcgattctcctgcttcagcctcccaagtcgctgggactacaggcgtaagccaccgctcctggctactttttgtatttttagtagagacagagtttcaccatgttggccaggatggtcttgatctcctgacctcatgatccacgtgcctcggcctcccaaagtgctgggattacaggcgtgagccactgcatccggccatgacttgattttttaaaaaattatgagatgaggaaacatgagggagttttgagtagaagagtgacatgatgtcatttatatttaaaaggatcactttgactactttgtagaaagtatacaggagaaggcagaggttgaagcctgaagtccacttgggaggctattgctatagtaccagaaagagtgattctcttccatctaggtagaaggggtgagtgttagtgagtttcagaatacaggagtcccctgttatccacagtttctctttctacagtttcagctacctgtggtcaactatggtctgaaaatgttaaatgggaaattctagaaataaacaattcttaattacattgctcaccattccaaggagcatgaaatcttgcaccatcttgctccatcctggaacaggaatcattttttgtccagcatatgcatgctgtgtaccctacccacctgtgtcacttagtagccatcttggttatcagatcaactgtcaaggtatcacagtgcttgtgttcaagtaacctttgttttacttaataatgcttccaaagctcaagagtgtgatgctggcctattgttataattcttctattttattatttgttattgttaatctcttgctgtgcctagtttgtaaactttattataggtatgtatgcactgtacaggaaaaaacataatggatatagggttaagtatgattcagagtttcaggcatccatggtgtggggggtgtcttggaacatatcgcccatagatgagggattactgtatatttataaaagacataaggaatttactactgaagtagacaaagggtgtgagacaaacatacaaatgaaagatgatagtaaggtttctggcatgagtccgagcaggaattaacttgccatttcctgagaaatttaccttgtttatacactgactgcttttattttttgttttctttgtttaaattataatggtttattcttgtccaagtgacaataggcatatctacttggagttttttaaacagtggaaatagtgtggtcagtagagccagcctgtacaagactgtttgtgaaatagttctattccatgctcatggaaagatttattgttctcttctttcctagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtgaatgtggtagtgctttcagtgatcaattacatcatatgtcacaaaaaacacagaggaacaaactgatatattcaaggtggaaagcccttgaataaaaccttatggctaataagcatatactcagagaaaaatagtatgaagtggagactgggaaattcttttatgggaagatagatcttctcatcagtgaccatagatcacatcttcagtgagcttatagttggtagaaatataatgatcatggaaaagtccttgttcagaaacagtacgccagtaggtatcagggggtttacacaggagagaaacttttggaagacctttgaaggctatgaatgtggcagggttgctagtggtacattctgccttatcctcagagggaatcatatagaaataaaactatgaaaatgtaactagaacatcttcatcaaaatatgaaagaacacacgaagcaaataagccctgtgaaaaggagtattttagagatttcgatcagaaatctaacatcattatatggcagataatatacaggatgtgtattttaggacaatataccttgaatcactagttgatatgtcaatgactaattaaaaggggttgtcagtgttacacatcattggttaaatttatagcacaatgtacctcttcccccttttttgataagagtcttctattcccaaccaagatcattatatgattagctcttgtgtttctttgattccaaatttcttcacttgttatttcagactactgaagctcttcaaaaggaaaaatgtatttaatttaataatgtaacacaacaagtttggatgtgtttaactttataaataatcaccccagaggaatgaagttcaaaacttgtgaataaccaattggccatgctcttaatttagaaggtagtcctcatcctaaccctgtggtttgtcttattgttggcataagcaccattcagaatagtttgaatgatctattttctttacctgaaactatttcctttatctaggaaccgtggatgatggcagtgggaaacaaagcaaaattgcaagccagcatttttaaaaagctggattatatgcatgtagctattttaccctccagcagctgtagttaaaaaatgcatatgcctatatcagttgaaagagacatacaatataagatcaaattgtcctgataatttcttattcaagggacatatttggagtgggaaggggaaaggactcaattttccttacataaaacaggatatgaatacttttctaaaaagtgttcatgtcttctctctacctaaattataaattccttgatagtttgtaggcaattgtatataccctagcagataccaaaatagaaattaattatatgtagatttggaagatgaatgaaggtgcatgaataacccagtggacaattatcaaaattacttttgccattgaaggaaaggaactactggcaagaacttctaaggattagtattattctaaaaaaaactttaaaaaaatctgaatagagactcatttctgtcataagaggggcagaagagagaaggaataggattcacagaataagcccaataaaagaacaaaataacttcattctctaaaaataaaggacagcatgtaagatgggtaaaggtgagatccttttggatatcttggataagaacccttaaatttatctacagacctgtcaccttggagagctgctactgttttaaagatcctggctcctctgtggtatgctgaattggaacataagatttctcttcatcattccttctcacttggggttaagacccttgtcctctcctatactcagagttccttcccttgatctaataaagatacatccatgttagaaacagtcctgctcacaaggaaaaataaagtggaaatttgccataaagtggctgcctcacagtggaaacccgaagtctgggttatcgggtgattacaacaaatagtttttgagcatctgcactgtggtagacacttgtacacacaggatacactgaagaacaaacataaagtagtggcctgtaacaggatggattcagtacagatgctctacagttaagagtataagaaatgaactcttcttcaacctggacttcagattctctctacttcttgccttgtgaatctgcacatcctatcatagcagtcgtagcatcttactccctgaacacataaatcagggtgcgctactgggcttcccaggcctgtccttgggaccaggtgttgaaatcacctttcagaagttggcatcccagctaaataaatttaactggatactcagttccaggttgcctctttcaaaaggcacatcaccccatgccttcataaaaatggtagccgacatttattaagcatgcggtttgccaaatggtaactgcattatttagtaatttaaaaaaattaaagtttgtttttgtttttgttgtgtttgagacagggtcgtgctctgtcgcccaggctggagtgcagtggcctgatcatggcttactgaagtctggacctcctgggctaaagccatcctcccacctcagcctccagagtggccgggactacaggtgcatgccaccacactctgctaatttttgtatttttgtattttttctgtaaaggcagtgtttcactatatttcccaggctggtctccaactcctgggcataagtgatcctcctgacttagcctcccaaattgctgagattacatgtttgagccatggcacccggcctctttagttatttaacactcttatatgctccatttccatcttcaagtgtttcagggaaatatttgattaaatttgaggcctcattcctttttccttattacaggtaaccacacactgtatgcagttgcacgtgggcattggtcctcatagagatcgctcccgtatttggcctcaagacaattctcggctagactagccttgcccattcttttctgcatccgttgaaggagattcagaacatccacaaatttggtccactctgtgaccgctgtccccctattccccttcagccacttcgcctttggcacaccttgttggtcctgaagaggccctcagaaatactccacattccgccctaaactcccaacagattgtattttctactgaatggaaactgacacctcctaagatgaactgcagccacgatgcttcttcctaacggctcaatatggggtacagcgcgcggccatcttatttttttgctcaggctgttaaaagtttttataattttctgacaatttatccagtttgcgcagtgactgaggtgccctgaaattaattcactgtcttccaacgccgtggtaacagcccttccgggttctctggtgggagtcgccgagatgggcgtggccatgatacgtcacaatacgaggccgagggaggaattctgtcgtctgggaacggctggtttcgcggtcagacgccgagggccctcgaagtccctagcaacggctgcggagggagatgtaagtcgttttggacgcaggctcagtgtttggtcccagcgttcggtggagtccggagagactcaggatcagatgagtcggggtctggatgtggctccaagtgaaaggcctgtgggggtcagtgaaggggagccccctgttctgagaccgtgtgggaccccgcgtcctggggttctttctgggtttactcaatggagaagcctggctttggtgatagggcgcctggcggtcagtaattaagagactggaagatattaacgaccgactgtcaaggtttatggtcgttgagggaatgccgtgggaatcagtggttgagaaacggggtaggaaagtgtgtatcagtgaatgaacttggtgtccattccgggtttgcaatttaatgtgatagagaagcttggggctggagaatgttttagtgaaagaggttttagtttgcggtttcagatttaatttggagtcaatgtttgaggaggcctgtacatgtctgtggtttaggggcctgaagaggctggagctttggaggcccaagggccctggagagtggatgggttgaggcttaataattgactgctggttacagttgtgattaaactacatttacctagtggatctacatgcagttcagttcttcaagtccaagtccgtcttaaaaataacaatgaaaaacatttcccttcctatattcatatcattgtctacaaatttctggacgaggaaattacgagtttgctactaaagtcgagcttttttcctctctagttcccaactttaccatgtcgttttcataaatattttctttcagatttattccaacacaagaaaataatctctgttacccacacttctgatttttatttaggagcattttttttttcgtttcatcctcacagttttcacaattgcaatactttgggtaaatatttgatttcatcacttaaattctcatcacaaacatacatacatgtatgtatatatagtatatatatctatatttctgtctctatatacatctgtctatgtatgtatgtatgtatctatctatctatctatctatctatctatctatctatctatctatctatctttctatacagagagagtcagtcttgccctgtctcccaggctggagtacaatggtgccatcagctcactctaaccttgaactcctgggtttaagggatcctcctgcctcagcctcccaagtagctggactacatataaaatttttcaatggcagtatcacatcagaaggttgtaccagtggcttagtaaatggagtcacattaaatgtttgccttaattaggatggaattgacatgtataaaatattcaattctatttctatattttctatctatatataacattctgatactccaattactcaagttcttctgttcccaccccaagatttgtgattcacttttttatgtcctagatcttatggttacatttattcttaagtggcttatactgttttttttgataattcctctagaagaggaagtcattttttaaaaattgagacagagtctcacaccgttgcccaggctagagtgcagtagtatgatcttggctcactgcaacctccgcctcccagactcaagggattctcccacttcagtagctgggactacaggcactcgccaccatgcccagctaatttttgtattttttgtagaaatgaggtttcaccatgttgcccaggctggtcttgaactcctgagcccaagtgatccacctgatgcattacctgcctcggactccaaagtgctaggattacaggcgtgagcgactgctcctagccaagcgtttcttaaatccaaatatttgctggagtatgcgtacctaatgcatgtatgaaggcctatccctctgagagtctgggttgatagatttggagtacaatccctgcagagtgttgataaaattctctatggaatgctgttgtgacatacttggtaactcacagccctaatatatgctaaaatggatggaattttgtgagaaacaagaaaatatcttctagtagtgatgattttttgtaacaaatatatgaaatatctgtatgtaatacaggatttaaacacaaggtattgttagaattctaggttgtgtgaagttacatgtcaagatgttactgaaatgccaagggttcagtctaggtcccgttgcttgccacacagaaagacaatcactgagacaatgagtattgcgagagaagaaaggcttttttgggtaacatcaggtgggagaggaaaataaatatcaaatctgtctccccacaaccgactaaaattggtggcttatataacaggcaaggaatataaaacaggaattagggaagggtaaggaagaggagttggccaacaggaatcaggtggtcggttaggcaatcatgatggatgaggggtccaccatcgcattgtctagatgcagtgatctggtaagtttcagttccttgaactatctgggaggcctgaatggtttcatgagaaacgaactcagataaaatgaatataagtttcaagctttaagactaggagagtcaatttctatatttattcaaaaagactgttaacatcatttctgtggggaaatccagccagtttaaaaaatgatcagcaaagatagggaatatggtagaaatgtaaaggaaatagaggttaaagtgatatatagagcatagggaatgatggcatgatatgtaaaaggcatgtctaaattttgaataaacataatgaagggcagagaatgaagggattaaatggaaaatttgtcaggccatgagggagaatgccaaaagatttggtccgaagccaaccatatgaaagccaatgttagaaggtgtctgtaggggaagtagtagaatagaaatgtggataagtggggtaatcatagcaacattaacttttattgccaggccgagtggattttgtgttagtaattgaggtagcatggtagagggtaggtttcttttgtatttttctagcctatgggtagtcttatctttcacccagtgacagcaatgatgcaataataaggaacagccagagtttcatatataaataaatatataaattatatatatatatcttttgagatggaatcttgctctttcacccaggctagagtgcaatggtgtgatctcagctcactgcaacctccacctcctgggttcaagcaattctcccaccccagcctccctagtagctgggattacaggcgcccaccaccatgcccagctaattttttgtatttttagtagagatggggcttcaccatgttggccaggttggtctcgaactccagacctcaggtgatccacccgcctcagcctcctaaagtgctgggattacaggcgtgaaccaccaccttacattctggctggggaaaacaaaataaaaacacaaggaaactaaaaaatgaggtagctgcaaattatgagagaaaacacacactgcctatatccaatcagggaaataagcagacacacttgttttaaacaaatatcttgggagaggcaagtcagaatgtcagatttcgacttcaacgtatctgtgacactcttagatggtcatcctgtttttaaaatgcatcccttagggaggtgggggggtcagccccccgcccggccagccgccccgtccgggagatgaggggcgcctctgcccagccgcccctactgggaagtgaggagcccctctgcccggccagccgccccatccgggagggaggtgggggggtcagccccccgcccggccagccgccccgtccgggagggaggtgggggggtcagccccccgcccggccagccgccccgtccgggaggtgaggggcgcctctgcctggccgcccctactgggaagtgaggagcccctctgcccggccaccaccccgtctgggaggtgtacctaacagctcattgagaacgggccatgatgacaatggcggttttgtggaatagaaaggggggaaaggtggggaaaagattgagaaatcggatggttgcggtgtctgtgtagaaagaggtagacatgggagacttttcattttgctctgtactaagaaaaattcttatcctgttgatctgtgaccttacccccaaccctgtgctctctgaaacatgtgctgtgtccactcagggttaaatggattaagggcggtgcaagatgtgctttgttgaacagatgcttgaaggcagcatgctcgttaagagtcatcaccactccctaatctcaagtacccagggacacaaacactgcagaaggccgcagggtcctctgcctaggaaaaccagagacctttgttcacttgtttatctgctgaccttccctccactattgtcctatgaccctgccaaatccccctctgcgagaaacacccaagaatgaacaataaaaaaaaataaaaataaaaataaaatgcatcccttttcttcattctgtatcatcaaactaattttcccaaagcaccaatctcacatttagagagaaacttattctcagtgtccaacctttagcctcactgtgggcacattctcctgtgcttctaaagaaagagggaaagatgagaaacaatgatcatttggaaagtttgcaacaggccaatgaaccatgtagacctctccagaagcagatgtgcttctgaataggataagatgtgttactgaatgggtgctactgctggtgcccacatgtgttgtctgtcaccttcagtcacatttggcatgtagtacctacacagatgtcagatctgaatttttcccatttcattgtccctaatacactgatcccttgtcatgtaactaatagcatcttctataattctacaattatgtcttggttggcatcacaaaaggggcctaagggaccaccttattccttttaaaccaagactcatgccacctttacatatttcttagaaaggaggatatataatggaggaagacaaggctcaccgatgagttcaaaacaaggggacgaagaaagtgaggaattaaggtttgctcctaagtattttgcttgagtcaagagactttttttttgaaagatatatttaacattttacattatgtatataatagtcaaaaagtcttttatctcagtcaatgaatattttatttcagtgaaagggtcttatatatcggggacatctggcctgggatctaggaaacatggaaggaaattaatctgtaataaagtgttagtaattaagaggtcaagctctatgactcagtctccaaagtcaactttcctcaagtcctaataacttttagacgcccccaatatacagactattttcttttaggctcaactttctttacataagacatgtgaatccacacgtctatgccttctacattttagtgcaaggattagtaaaaagtaactaatagagcgctttccagtttggttaaagggagtcctttaaccaaatatcattttagatatcatttccagtagaaaaaaatctcctggctgaagttcatgggttttaagttctttgtttcctgggagttcactataaaaagagtcttttttcaaattatgatttttaggtagttgttttataaagatgtcagaaaaatttaatatgtcttcttttagcattatggatttatactttcctggggatagtttcatgcatctacctgttattatctcaattagggaaaactgatgtctaccaaaaggggtggattttaggttaaggaaaaccagtggaagggcccttggccaagacatgtgaaaagcctgggttaattttgccaattgaattttaattattttgtttatgcattctactaatgcagatgactgagggggatatgcagaatggaagtgttaaagaattggccatattttacgtagtgactgaattacatgggcagtgaaatgagtacctctgcccctatgaagttctagagagactcctcaagtctaaataatttttcaaggagaattttacttaatgttagggctgttgctcttctgcatggaaatgcttctacccaatgaaactatacagactttcattactagaacatacttgtatccttgtgatggggtagtcgaataaaatctgccacacctcaaagggggcctcaggtaaagaaaaatgttcttaggaactatgtaaaggtttccctggattatattttgggcaaatatggcagcaactaaatgctttatgagctatagttgaagaaacttttcaaaatactatttttctcaataaccactttatcagggctccggtgaattaaatcagtccgtagggttgaaaatgatgattgtaattcagtaggaagtataggcaagttgtttagtccacaccatatttcacctttttgttttatattttctaattctgtttttagagctctggattgggttaatttatgtcaaatttgggggcttctttcaaagttaatatgaattgtttttattgcctagatgtatttaggcagtcctcattgtaaccttatgagctagctgacttccttcactttctggagtatctgatttggaattttttggagtatctgatttggattttaataataggtagtgagttttataataatgtttttttaataataaagagataaggtatccattttttatggactggccggaagaggttcaagaccctctttatttattttcacagtattacaaagtcacgaatgacttcaaaggtatatctgttgcctgtatataaattagcagttgttcattttgccaactgacaagctctaattagtgctgtcaatttggcttgttcagcagagattgcttctagaagataagcactttctattttttcccttgggatattataacataacctgcttgtaaatttgagattaatctttaagtaagatctgtctgtaaatcaaaccacaccagtgttactaagatgagtttcttgcaggtttgtcctaggagagaaaagctgaccagttaaggttatgcaatcatgaggcatttcatccaaatttagggggagaagagtagcagaatttaggttattacatgtagacattgtcatatgaggtccagaaagaagtaagacttctaaagggactagcttgctaactaagtaattctgagcatgaagtgaatttagaagtgcttccaggctggcatgctggctcatgcctgtaattctagcactttgggaggccaaggtgggtagattccttgaactcagaagttcaagaccagcctgggcaacatggtgaaaccccatctctacttaaaatacaaaaattagtcaggggtggtggcaggcacctatagtccctgctactcagaggctgaggtgggaggatggcttgagcccaggaggcggaggttgcagtgagccaaaatcacaccactgcagtccagcctgggcaatagagccagaccctgtctcaaaaaaaaaaaaaaaaaaaaaaaagattatgcaatcacgaggcatttcattcaaatttaggggcagtttcatatgaggtgaagaaagaagtaggacttctaaagggaccagcctgctaactaaatatttctgagtatggagtgaatttagaagtgcttccaggctgggtgtggttgcttatgcctataatcctagcacattgcgaggctgaggcaagaggctctcttgagctcgggaatttgagaccagcctgggaaacataaggagacacccctgcctccagaaaaaaaatttaaaacttagccaggcatgttggcatgcacctgaagtcccacctaggtaggaggctgaggtgggaagattgcttgagcccaggaggtttaccagtagggtgattgctgtattaaccccatgcaggctggtagtcctctagccactgaatccaactgctgactgttgtattatataggtctcttttgagccccatgtttttgggtcataatgcctagggtattttcttgatcttcctgtacaaacaacgtaaacaaaataatttggatttcctagtactggggcatctataagatcctttaaattgttcctaacattaattgatttttctctgtccaatccagagagtctgcttgtctcattttaaaagggtatagaaaggtaagcttttaatgaaaaattcagaatctaatttctgcaataattttccagttccagaaatcctcttaggtgttttcttagtttttagggtaagcaaggaaaatatttgttttattctatttgcatcaataaaaaggcttttcttggacaatagataactctaaatattttactcattgtagacagaactcaagattttttattggagaccccatgtctctttgaaagcaatttttgtaacaagtgaatcccatctttttgtagcagctttctcatcttctgaacaaagaaggaaatcatccacatattgtattaaagtatagttttcaaaaatgcagcatataagacatttggtttcaatatttctgagaaataagttggactctgagtatattcctgaggcacaatcatccatgtccattgtttgtctttccatgtgaagccagtagtgtgggggaaagcaagagagatcagactattactatatctatgtagaaagaaaaagacgtaacaaactccattttattccgtactaagaaaaattcttctgccttgagatgctgttaatctgtaaccctagccccaaccttgtgcttgcagagacatgtgctgtgttgactcaaggtttaatggatttagggctgtgcaggacgtgctttgttaaaaatgtgtttgaaggtagtatgcttggtaaaagtcatcgccattctccagtctcaagtacccagggacacaatgcattgcagaaggccacagggacctctgccctagaaagcctgggtattgtccaaggtttctctccactgagacagcctgagatatggcctcatgggaagggaaagacctggccatcccccagcctgacacccataaagggtctgggctgaggaggattcgtgaaagaggaagatctctttgcagttgagataagaggaaggcatctgtctcctgctcatccctgggaatggaatatctcagtgtaaaacttgatcatacattctatttactgagataggagaaaactgccttatggctggaggtgagatatgctgggggcaatactgctctttactgcactgagatgcttgtgtaaagtcaaacataaatctggcctacgtgcacatcaaggcacacacagcacctttccttaaacttatttatgacacagagtcctttgctcacgtgttttcctgctgaccctctccccaccattaccctatagtcctgccacatccccctcaccgagattgtaaagatagtgatcaataaatactgaagaaactcagagaccagtgctggcgtgggtcctccatacgctgagtgctggtcctctgggcccactgttctttctctatactttgtctctgtgtcttatttcttttctcagtctctcatcctacctgacgagaaacacccacaggtgtggaggggctggcccccttcagctgtacacaagcaaacaccagattctccattctcaggttccattactctatgctgtacatttgattcttattccgccccttctgaggtatcttgtggtcttatacgctaccaggaatttgcaagtactttcccttcttgtgaagtgtttggcacacaggaaaacatgagggaatattagttactatacttgtcctttcatgaatcatttgaaatgtcacttcttcagacagcattctgggatgcctctcagttttgtcttatttataataatgcaatcattaaatataaaattgcaactcttaagtggggctaaggaagggaactatagaaggcattcaatagggaaatagaggaagcatctctcttccgggaataattgaagatcatttttcctgatcatcatcatctgctcacttaactgctgttcagaatggactgtgagttccacaaaggcagaagtctataatttatttttagccccagtgctcagaacaaaaactggaacacagcacttcaataataagactattgaacaaataaccatatttggctgacaggctacagtctttccttcttcacttaccctcaaggtgctgtgctgctgctcagtgataattaaacatagaaaagatgcagctgggcgcggtgcctcacacctgtagtcccagcactttgggaggccgaggcggtgtatcacgaggtcaggagatagagaccatcctggccaacatggtgaaaccccatctctatgaaaaatacaaaatagttggctgtggtggcacgtgcctgtagtcccagctactcaggagtctgaggcaggagaatcacttgaacctgggaggcggaggttgcagtgagctgagatcgcaccactgcactccagcctggcaacagagcaagactccgtcacaaacaaaacatagaaaagatgcaaaagagtgtatgctgtatgccaccttttgaaaaaaggacaaataaataatatatacttgtattataaaaagaaacactggacggattcacagtaaacatgtttacctgtaaaagctagaaggtcaggggaaaactaggattgagaacaggataagatattcacaaatgtgcttttttgtacagctttaagttttgaatcgcatgactatgtgacctagtcaaactatttcagagtaaaaataaacagccagtagagtctctatcgccctaggagtggaggctgatcacagggtaatctaaggatgagatcataaaataaaacaaaccctccaagcaaaaaaaaaaaaaaaaagttttagatgccagaaaacatttgaatctacagcctgccacttggcagctaagtagcttgaaagctgttggagcaacactccttaattcaaccaaatactgtctcagcatctgcgaggtgcctgatctagtgcccaatgttggaggtgaaatgatgaggaaaaaacagacctgctctcttgaagggggccagcccttccacccctgtggatatttctcatcaggtgggatgagagactgagaaaagaaagaagacacagagacaaagtatagagaaagaacagtgggcccaggggaccggcgctcagcatacagaggacccacaccagcactggtctctgagttccctcagtatttattgatcactatctctaccatctcggtgagggggatatggcaggactatagggtgatggtggggagagggtcagcaggaaaacatgtgagcaaaggactctgtgtcataaataagtttaaggaaaggtgctgtgtgtgccttgttgtgcacataggccagatttatgtttgactttacacaaacatctcagtgcagtaaagatcagtattgcccccagcatgtctcacctccggccataaggcggttttctcctatctcagtaaacaaaatttacgattgggttttacactgagacattccattcccaaggacgagcaggagacagatggcttcctcttatctcaactgcaaagaggccttcctgttttactaatcctccagggcccaaaccctttatgggtgtcgggctgggggagggtcaagtctttcccttcccaagaggccatatctcaggctgtctcagtggggagaaaccttggacaatacccaggctttctagggcagaggtccctgtggccttccgcagtgcattgtgtccctgggtactcgagactggggaatggtgatgacttttaccaagcatactgcctgcaaacacattttaacaaagcacatcctgcacagccctaaatccattaaaccttgagtcaacacagcacatgtttctgtgagcacaaggttggggctagggttacagattaacagcatctcaaggcagaagaatttcttagtacagaacaaaatggagttccttatgtctactttcttcatagacacagtaacagtctgatctctctttcttttccccacactctctgccttcaggaagtttagaatccagatggggaatgcacatggaaatctacaaaatgttaaactgcagttcccctaagtgctaggaagaagaggaacacgatcctatggaaggccagactggtgagggaaagttgctctgaattagtgatgtttgaagatcctgaaggaggaaaaatgcagaaaatggggggaaagaaaagttcaggcagaagaaagagcatgcacagaggcctgaaggtgatgaaaggatgtcagcagcatatgaggggccaaaagagggccagtgtgtcagaacagggagagcaaggtggagtatgggagagggaagaaagaaccggaacatgcagacttgatggccattttaaggatgtttgccattgtccagaccccaagcagaacagtcattgcaagtttcaaagtttaaagctagagagtttcataatcacagctctattaagcttaaaaagtatgctatatgaggaatccttggctcagtgcgtggcaacctttttgtcatcaagtcacagttttgattaagttcaggcacacctatactcttgattcctcctcttcccctcactgggactaataacattacttgtattaattgtgtttcttgctagacactgttttaaggactttacatttacttctcacaacaaacctgaggcagatattttaaagctaaagtcaagaccttggtaaattagttgctctatggcacatggcttgggcatggcagggcaggattcaaactaagcagtgtgacttcaggatacattccaaatcactatgcaggactgcctcttggcccaggagggactgaggtcatgggagcagatgaagggtgatcttcagtgaaactataaggatcttgggtttgggagcagacatgatgtgtaccaagcttaggtatgcactgagcctccttcatctgggaggtcaagctctgaaaggtacgttaagcaattgctcagggtaggcctggccaactcatccttagaccctgatagagcataagcaacctgaccttaccatggaaggatgtgcagattcacaaaggccagatgtggatagggcctggttggtggagcgcccatttctgattctttgctggagagtatctgctctgaatctatcccattataatgtgggggtaatgatggggcactaatccaggatttagggcaaagatgcacaaaattaggtgtgcaccagaaagccctcattacaaatgcagagtgccaggttccagccccagaggatctggtttaggaagtctaggggtgactcagggatttgcatctttttaaatttctgagagacttgcggcaagaagctcacagacaattacaaatactcctggagtattctgtgcttacaaatgctgtaacaggctctcctcagtacacttaggtcttggctcaaattacatccagaaaagccttcccttggagaaaaaaaataacatatttttaaaagcccccatcactacgtatgcattagtatccactactagtctttttctccttcctaacatcgtacaatctgtttctctgcctcactcaatggtaaagtttataaaggttattcctttgcctgtattgttcaccgatccatcctactgtatctaaaacagtgccttgcacagtgatgatatataaaagttacttagtggccaggcgcagtggctcatgcctgtaatcccagcatttgggaggccgaagtgggtgaatcacgaggtcaggagtttgagaccagcctggcaaacatggtgaaagtccatctctactacaaatacaaaaaattagctgggcgtggtggcaggcacctgtaatcccagctactcgggaggctaaggcaggagaatcgcttgatcccgggaggcaaagtttgcagtgagctgagttcgtgccactgcattccatcctgggcgacagagcaaggctccatctcaaaaaaaaggttacctagtaacccaggatttctgttgaattctgacctagccacaaggcaaatttccatttattttcctatgagcagcacttactgtaacttggacagtgtatccatatgggatgaaggttaaaaaaccagataaagaaggccaagagacctactcccagaaaagtgagaatgatgaagataaatcatgtctcaaaaaaaaaaaaaagaaaagaaaaatcacatctcagttcagcaggtcacagagaagctgggatctctgaaatggtaaccctagcgggtgataggtcttatggacaaataaaagcgtcatctctaagacgtcccaaaagaaacccacctcctcccatctgttacagtctcatccattctcagagactaagattttcctcctcctttgtgttctacttattctaagagtccttttccttttctgctctgccccttttatatttggctaagtctttctaatcacacaaaagttgtgagtgacaattctattctttacaactgtcattcccttcaatgacaaaatacgcttctctttccaaatcattctctctccaaatcaatacataattagtttttgtttttctatgtgttgggaaatattagatcatgcaaagcagcctctccagcataactttctgggatgttggaaataatgacaaagagtcctcattgtctgaaagttctgttcactctgctgtccagtttagtagcctctactcacatatacagctcttgagcagtgagggaactgaatttttaaattttgtgttcagtttctttaattctaaaatttaagtagctacaaaacttagcagggaatttgtaatctcttggagagataagacacgggcaaaaacaaacaaacaaaaagccctcctttttgtactaaggtgcttaagtaccattaacagcagtccttctgctactccttgaacaataaattatcgcgtcccctggacacagttactccatgtccatttcacctaatgtagatatttgcaccgcctgactagattgcctgagtgtaatgataccacttaaaattaaccccacaaactctccaggagaccacaaactttttcttctttgacctcagctcctggaacaggacaaggtacaaaggaaataattttaaaatatttgtttaatgaaacaaattgactagtttcacagatccctctgcataatacaaagttctgaaagtttatggtcctggttttcaattaatcctccacactggcactggtctaaggaaactgaattgacacatatgtgtcccacattccaccattacagtattagccctttcccaccaactgccccttatgaagcttttcagtcactgcaacactcccgacaccaattatctcatctgttttaaaaattcacagtacttcatttcctccacttaaaagtacttgggcttcctttactcatttaattgacacagtcgagcaattgctgtgtatgtgcttaggttaacatcaaatttgcctgtgtatcacagcatacattttaataggatgagtttatcaggctatctcagccttatacatgttctctcagtgtatgcttttcggccacataatgaactacaaatttttgctcaacccttttccacatagatctgagttttcttcctatgggttttctgtaacataaaataagacataattgatcacggaaggcacaaccacattcactgcattcacaaggtttctgtcctgtgcaaatcctctgttatctcctgaggctgcacatctgaccactggctgtcccacaaggactacgttcctgtttgcgaggaggccgctgatgtttaatgatgtctgaggggccacagaaggcacttgtgtagtcgccccgttagcagagtttttctcctgcatgacatcactggtgtgtaatgagctgtgcctctctgcaggaggattttccaccttggctgcctcttgtttctcccttgtgtgtattctcttatgcttaaccagacacgacatatacgcaaacgctttcccacactcgttacagccatagggtctctctcctgtatgagtcctttgatggacaatgagcttttgctttgtgctaaaggctttcccacattcactacattcaaagggtttctctcctgtgtgaattctttgatgtttaatgagacctgatttctgagaacaggattttccacattcactgcacacaaagggcgtctttcctgtgtgaaatctctgatgtgctatgagacacgtcttctgaatgaagccttttccacattcattgcatatataaggtttctcacctgtatgaattcgctggtgtacaatgagatttcctttctggatgaagccttttccacattcactgcatatatagggtttctctccggtatgtgttttctgatgtatgttgagccgtgatttcttgagaaaggctttgccacattcagggcattcataaggtttttctcctgtatgagttcgctgatgttcagtaagcatgaactttctggagaaggctttctcacatagactacatctgtggggtttctctcctgtatgcattacctggtgatcagttagccaagacttcttgatgaaggctttcccacattcactgcacacatgatgcttctctaattttcgtgttttctgatgcttgggactgatgaattgggacttagtgctgatgagtttttgacttgcagggaatttaattgcagtatgaagtcgttcatggttagcatgaagaaaggagtccccatttccagtaaactcaacagagttctttatttcatagcctttgctctggttaactaaagttaaattggatttcaaactttttccacgtaagtcaaatatatcatgattttgccctaacagaaactgacttttgctgcaatgaacaatattttcaaatgcatcatgttcatgacatggtttccttctgttcaccaggctttcactctgcaagcgctccagcacatgatcaactttccatatgtctagaaagaaaagaacaaagatttctatcatttagatttggggtaaaagtttgttgtggtttttttgttttttttgtttttttttttaagatggagttttactccgttgtccaggctggagtgcaatgctgcgatctcagctcactgcaacctctgcttcccgggttcaagggattctcctgcctcagcctcccaagttgctgggattacaggtgcctgctaccatgcccggctaatttttgtagttttactacagacggggtctcaccatgttggccaggctggtctcgaactcctgacctcaggtgagccattgtgctcagccaaagtattttttgttttgttttgtttttgggagacggagtctcactctgtcgcccaggctggagtgcagtggtacaatcccggctcacagccaaagtattttttgttgttttttttttgttttttggggacggagtctcactctgtagcccaggctggagtgcagtgacatgatcccggctcactgcaacctccacctcctgagttcaagcgattctcctgcctcagcctcccgagtagctgggattacaggcatgcaccaccgcacccagctaattctgtatatttagtagagacggcgtttcaccatgttagccaggctgatctcgaactcccgacctcaggtgatctgcccgcttcagtctcccaaagttctgggattacaggtgtgagccgctgcacccggccccaaagtattcttttttttaatgccttgatgtgaggtgtctcttagtaataaccctatgacctgagtgtaaataaaactccatgtttaatgttccttgcacattggcaaaaagtaatagtataaacaaactaaaaggtgaaagcagttagcataaaacaaggttagatcactaataataaagacagatttggctgctttctaaatgtgccttgcaaaacagaccttaaaatacaagcaattcactgtgaccagcagaccagaggctggaggcccatttcgtccaaagaacagattcattcattccacatactcttactgaatgatcaccgtgtgccaggtatggtgctggtgttggggataggcacaagaatcgcttgaatccaggaggtggaggttgcggtgagccaagttcacaccattgcgctccagcctgggcacagagcaagactctgtcttaaaaaaaaaataaattaataaaaataaataataataatgaataatttttaagggaatgagtcagggaagtaatcatatgtgtggaacacaccaggcagggtttaggaaagaggatggaaatctctttgtgagcaagatggtattatatcacagagatcactgaaatgagaaatttgacaggtaacatggtttactgggacttggtgtcatcagaatacgatggggaaaaaaacgaaagcaaattattaaatacagaaaggaaccaaatggaagtaggcgggagttgagaatgtaggatgttaaaaaaatgacttttttacttagagatgcatcatgactagcagagacctttaaagaagagagctcttcaggcaggtaatacccagatggccaagattcaggatgtacaggaacaaacgaaaatccaaacttaatggttttcttggaggaaagatgattctagttccttgcagttactaggaactcaggggagagttgccatgaagtaaattacacagaactaaaatctgtgttagataacaacagggagatgtcagtttgggactctcctccagggagcggaaggagtttaaacttactagaatgaaggcaattttgaagagtgaagggcacagatgagaaaatggagaacgggacctttggagaacctaagaataaggaaaaagagaagcgaaggaagccaaggcacagcgaaagtccagtttaccctgaggaagccacatccatcacaggggaggtgttaggaggggaggtcagcattagccaaggggcacaaaggggtgggagtccgaaaacagtgaggacttcaaagtttcctctttggaaagaggcctggaaggtggaatttcgtaacaagagaggtggaacaacatgaagaagggaaatacttgaaacccgaggaagaagaaaattatgcaggcaaacaaacaatatgtagataaaataatcagatctctgaggagataaagagtttttgttttgttttgtttttttttaactctaaattcctacaaagaaaaactggtctcacactgggagacagatgagtagaggaactgtttacatatcctcaaacccccttcacagctgtgctgccttctctgactgtctagaatgtgacttccatagccttctgtcttgtgggttctctcacctgaacaggctccactgtggattccatcttcaattgtccacagttgttctccttgttccaacttgaagagtgcatccggtttgctggcttgataccctgttcatggaaaatgatagaggacttagacatatcaaattgggctggcaatgtcaagaaggaagaatgttacatttcaagaaacttgagtttcttaaaatacccaaaatttagtttcttatctgaaactatgaaagtttcgtttcatatctgtaacatcaaggtttttctcttacaagagggtagattacaccgtcttgtgtgggagcaagagaaggatctgagaatctaccacttcagagtactgcaggcattccaaagaggtaggcatctgagaaaggaaggccactgactaggcaccctctgagtgacacagggcagctgtcctcacccactgccaccaggttgctgtagttctccaacatcacatcccggtacaggtccttctgagcagcgcccaggagttgccactcctcccaagtgaagtccacagccacatcctccagtgttatggattcctgtaataacagtcctgtttaataaagtgatgtctttttgatgatgtggaagaaatgctaaagtttttctgctcatttccactctacaggctgtgtgcatataccaaatagttttttttttaatacaatgtggaagaagtaaagtcctaatataatattctgtaactgtatattcagtcatcctccattcacccaattggaagtttctataaagtgtagaagttaaatcttgctaacctaaaaacaatatatttatacattttatatatgtaaatatatatgaatatatgtacatatatttattttagatacatgcaaatgaaagacatatatacagccatcctttagtatctgtagggtattggttccaggacctcctgaggatactgaggtgtctgatataaaatggcacagtattggtcaggcacagtagatcacacctgtaatcccagcactttcggaggccaaggcaggagggtcactcgagcccaggagttcaagaccagcctgggcaacatgagaccccatctgtacaaaaaattaaaaaattagctaggcacagtggtgagtgcctgtggtcccagctacttgggaggctgaggcaggaggctcatttgagcctaggagttagagactacactgagttatgaccatgctactgcactgcagcctaagcaacagagcaagactgtctctaataaaataaaataaaatggaatagtacttgcagatttgcatgtaacccatgcacatcctcccatatacatttctgtttttttgaaatggagactcactctctttcccaggctggggtgcagtggcataatctcagctcactgcaacctccgcctcccaggagcaggcaattcttctgccccagcctcccaagtagctaggactacaggcatgtgacactacgcctggctaatttttttttttttttttttgagacggagttttgctcctctttcccaggctggagtgcaatggtacaatcttggctcactgcaacctccgcctcccaggttcaagcgattctcctgcctcagcctcccgagtagctaggattacaggtgcccgccaccacaaccagctaattttttgtatttttagtagagatggggtttcactatgttggccaggctgttctcaaactcctgaccttagacgatccacccacctcagcctcccaaagtgctggagttacaggagtgagccaccgtgcccagccccatatactttaaattatctttagattacttataatatctaatacaatgtaaatggtatgttaacagttgttatactatattgtttagggaatcatgacaataaaaaagtctgtatgtgctcagttcagatgcttaaaaaatatatattttcaatcctcagttggttgaatccatggatgtggaagccatggatatggagggccaaccatatatcacaaatccaggcctcctatttttctgatggactaattataaactgagggttcctatgacctccttgagtttgataatttctcaagaagaaggagaaaatcaagtaatggagaaacaatatccaaagatctaacactgaaaatttttcagaactgattaaacactccaaaattcaaactcaagaaatccaacaacttttcaagcaagaagtctacacgtaggcacaacagattgaaactaaattacaccagatacaaagggagactataaaaaaatccaaagaccaatgacaggttacctacaaaggagacaaaattttctgacagctgactgctccacagaaatcattatagccaataaatattggaacaataaatgtaaggtcctcagctcttggacaacacagcccaaccttgaagaccatttaggactgaaaggcatggctggcaaaggacctacagccctgtaatagtgacaattaagactacttatcaatgaattgtcaatctcttgtctcaggatgcaggatggctttaaaggatactgctggtgggaaattgagtcattgaagacccagggaacagcagaaggtacactctatactcattttattacagaggccagtgaacacacttggtagatgatacaagtacttaatcctggttggtttacccattctaaattatttatgtgagatagctatctatttggaaaaaagtaaagtgaaagtcttacctcaatccacactcaaaaatagtttactatatgacagatctatggcaggcagatttgatggctcaatgaactccaccctcccagtgttcacacctttatgtagttcccacttacagggagccaaaggtccgtgggacgtgaccaactcagcattccactggaggctatatgatcaaacagcaaactgtttatcatgaatgcaggatgtgagcaaactcaccattgctcctgccgacagaaggttttctggaggcaatcactccctggtgctgaggttatctactgcaacatttagagaatgtagtcttgcaagcctcctctggactgagcagctgacccctacttccactgcacccccccaactatctcttttgcctaataaatgcagagggctgtgtaaagctcagggcccttgtccactagaggcaaggtaccccctgaccccttcctccgaatatacttttgtctcttgtcttttattcctgtgttcaccccactgtgttcagtccccctaggtctgtgcgggttacaagtggcgcccaaacagggacagaattgggtgctctacaccctctccttgagcagggactggcctagtgacttacctctattcagaatatggcaaaggcgttggaatctcacctccttaattaagctatacatgtttaaaaaaattattcaatgagaattgttaaagcacagtaaggaagactttattcagggccattatgacaggtatatagacaaatgtaatgggattttgcagtggtagagggtgaatggacttaactccaaatatcagcataagcaagtgggaatttatagccaaggagcagagtatgggtcagtaatacaaaattaccaagagggccaggcacaatggcttatgcctgtaatcccagcactttgggaggcaggaggattgcttgagcccaggagttcaagagcagcctgggcaacatgacaagaccccatctcaattaaaaaaaaaaaaaaaaggaaaaaagaaaaaaagcagaaaagtaaaagtaaaaaataaactcatagtcaacccacccccgccacacacacacacacaaaacctttatgatcttttatcatttttcagattaaatacttgattctctcctaacccccaatggtgacaaatgcatttttttcaagtatagctataaactgatggaattttatataattaatgttcttcaatcatttgcaatcattggtctttggatgttcaaagtgtagcatcttcggccaatgaagagtcccttcaagttggctgctatgttctttgaaatatgattctatcatgtaaaatatatatatgtgtatatcataatgaatatatatatctacagatagattcatatatactcacacttttattaatacatatatagacatagatccacaaacagatacagtgacaggaagtaaatattaccaaccatttacagaagtggattaggaagaaaatatgtgaaaagaaaactttttctcttttcttcaattttactaaatatagacaaggtctcactagattgcccaggctagtctcaaactcctgggctcaaggaatcctcctgcctaagcctcccaaagtaggcataagccactgcactcagccagaaactttttttttttttttttttgagatggagtctctctgtcacccaggctggagtgcagtggcaccatttcggctcactgcaatttccgtctcctgggttcacgccattctcctgcctcagcctcccgagtagctgggactacaggcacctgccaccacacccgaccaattttttgtatttttagtagagacagggtttcacggtgtgagccaggatggtctcgatctccagacctcgtgatccacccacctcggtctcccaaagtgctggattacagccatgagccaccgcgcccagccgaaatttattttttgatatgtgtactttcttactttactgggacacaatcacagatgacctatgtggctgatcttaggtccacaccctcccagaagtcaggttttaactttagcctctagttctggaagtttctggcctatcatagatcacagatctatcatagttcgtatttttaggctgtccagtggccaaaggacccaagcaaacaaagacactaccattagcaagatattccagaagcccagagctcaccctccattagcttgaacacaaaggccaaaactccctttgttcaattatttactatacaataaggacttggcattttctacaaggtgaaagtctaaaggaaatctgtaaactccaatccaagtcctgttcagacaatatcactttcaactccctgtctccaaatctatattcaaacaccagttcagctatctgttcattgagaaccatttgaaagtcctggaatcctgccatattcccaggatgtctaggttttattccaagttaaatccagactgccacaaggctgaaattaacttgtgttggtccctgtgtttactgtttgcttagtctattccgtaacagtatataaggagtccttcaagaaacagccacaggaaacctgcatctgaatttatgagaaggctgctattctggacaccatccaccacatcaactctaggaagaaccactgaagaaatttcctgagaccaaagtgccatgaaataatggcaacccccaggaagtaatctgttttatcttcaaaaacaggacataccatgtaaattatgattttcttgtgacattggctgtcagagatattagatgcaagctgacagctaatataatccacaggatcctccagccatgcatggtgtcacaaaattcataatttagtgttaatgctatgaacattatattccttatcctactattttgcatgatattgagtttaaaaactaagcttacttctctccagatcctgctttttgaaatttatactttttatattagtgaaattgatgtttataggcttctacaaatctattatggaacaaaggaaagaataaaacaaaccaaaagtcagttacctgggcctggatcattttcttctgttcttggaagacagcattcaactgggatggtctgtctttgtatcttctggccttctcttcagaagtctcagttttcaatcaagtgtgccccaagaaatggtgaaccccaaatccacttcctccctcttcaggttatgttttttgctcctgaggagtcagaacctgtgggttgaagagcaaattcaatgtaagtggtacattttttccaggcccagatactgtcactgctgctaggcactcatcttaaagcaatgcccccaatatagttaactatatacctttgtttggagccccagcggattttatacctgtggccaataatgtctaggattcttaatgtggtggaggtatgcctttcctctgtgacgtttccgtggaaggactgtgaaggcaggtaggaaatgagacccaccatagcaccagcctcaggagatggtgaactcttaggcagattagttttagaaaagagacaatcagcaaggagaggacctggtctttgttttcctttaaatcatgtgtgctcccacacctcttcaaaagtctttgtacatacaccctgtgaagacatgtacttcagtttgaaagccaatgtactgggcaaatcataagcattgtcataaaaacagtactgacaatattttaggaggttttaaatacataaaaagctaaaatacacaataatttactggataattaggtggtgaataaagttgacgtgctctaaggtttctgtagaatggaaaagtgccaattagcagaagaatatgacaaaggttgcacactacatgtaatctctagttacaattaacactagtaagtccaggcacagtggctcacgcctgtaatcccagcactttgggatgccgaggcgggtggatcacctgacatcaggagtccgagaccggcctagccaacatggtgaaaccccatctctataaaaatacagttattccagaagctgaggcagaagaattgcttgaatccgggagatggaggttgcagtgagacaagcctgtgccattgtactccagtctggtcaaaaagagcgaaacctcgtcttaaaaaaaaaaaaaaaaaaaaaaactagtaattgttttaaagtacgtaagttccatgccaacaaaagggggaaatgtaataacaagaaattcatccaaaagaagagaatcaaaaacagagcaaaaagagcaaatacaatgcatttagatagctgttttaaaataaaatgtactaagaaaattacattacattaagtattttatgctaagtaaaaacagagcatggatcccagttaattacattaaatataaatgcctcaaaactgtcagaatggattaaaaattaaaatccaataacatctggggtttattttattttattttaatttttgagatggagtctcactctgtcgcccaggctggagtgcaatggtgtgatctcggcctcccgggttcaagcaattctctgccttagcctcccgagtagctgagtttacaggcacctgctgcagggagccgaaggctcgtggcccgtgggacgtgaccaactcagcattccactggaggctacagatcaaacagcaaactgtttatcatgaatgcaggatgtcagcaaactcatgactgctccggctgatgaaggtttgctggaggcaatcactccctggcgccgttatctactgcgacatctagagaatgcagtcttgcaagactactctggacccctggcgccgttatctactgcgacatctagagaatgcagtcttgcaagactactctggacccctggcgccgttatctactgcgacatctagagaatgcagtcttgcaagactactctggaccgagcagctgaccccttcttccacctccccttctcactgtctcttttgcctaataaatatgaagggctgtgtaaagctcagggcccttgtcccctagaggcaaagcgcccccgatcccttcttccaaatacactcttttgtctcatctttattcccgtgttcaccccactttgtttagtccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataaggtcagtgccctaaagaggtactgggagcagtgctttaaagaagtactgggaagttttctgactcagggtaacaagggaaagaatttgtctattgaagaaaaacattatgtgcagttgcttaaagttctgttgagacagtctgcagctcaggttaattcgcagacactaacctcctgcagaagccacaaaaggttattacacataacccatcgtttccacaggcaggcactcttgatgtggaaaattgggatacagcaggagaaggattaaaacaggctcatcaaaaaggtcttaaagtcgattcttctgttttctccacttggagtttagttcgtactgtacttctgccattatctcattattattctgcaggacagcaagctgaatctaaaaatctgaaagaatttgttgacccacccacagctccaattaaaaataaaaaacaggagagggaggataaaaattggcctatactgcctccttcagttgcagaaacatctgtactgcctccttcggtggcagaaatagaaaccctaatacaaagaatttaatgctctgctgccatagctggagagcccttaggacattgtgcttttcctatttccatcaggcctgatccaaaaaatccacagcaggttattcatgaacacaccccactagagtttaagttgttgaaggaattaaaagcaagagtggtaaatgatggcatacagagcccattcaccttaggattgctagaatctgtgtttggtgctatgcgttttttaccctttgatgtgagacacttggcgcgaacttgcttgtctgctagtgcatatctgacatggaatttaaattggcaagaaatgtgtgcagaccaggctaaacagaaccatgctgctggacacggagacattacagaggatatgctgttaggtcatggcccttattcagatgtagaacgtcaaatggcactcccagatgctgcttatcagcagtgtacacaggccgctaaatgcgcctgggccacaatcctgaagagggagtccctgtacaatcctttttacatatcatgcaagggttgcaggaaccctatgcacaatttcttgcaagattacatgaggcactgaagcgtcagattcctcatactgtggctgcagaaatgctaaccttaactttagcttttgagaatgcaaacgtgtactgtaaacgtgcactggcaccagtgaggtgtacaaaaaacttgggaaattttctcagagcttgtcaggatgtaggaactgagattcatcgatctgcaaagttagcataagcaatggctaatttagcagttgacaaatctaaaaggagccaagggtcaaaccctaaagtgggaaaatgttgtaattgtggaaaaactggacatctaaaaaaggaatgccgccagatctcaggacagaaaggatattacaatgcagttcactccctagcagaaaaaacagcaggactctgtactcgccataacaaaggaaatcactgggctacccagtgctgctcaaaatttcatcagaatggcaccccattggtaaatgagatgggggcctgcacccgggcccctcaaacaatgagggcattcccaatgcagaccacaaccccacttcagggatgggttcctggaggcacattgattccctcaacccaggaacaccaggaagtgcaggattagatctacccaccagagaaagaatcacattagttaggggagacaaacctatttgggtatttggggacctttaccgacaggatacacaggactaattttaggtaaaagctgccttaacttgcaaggcatcactgtagtcctaggaatgactgactccgattatgaaggagaaattcaagtagttttaatgtcacaaaatctttgggtttttgaactgggagaatatattgctcaattattgcttattccctgtgaattacacccttccccatgaaaagagaaatgaggaaataaagggtttgggagcacaactacatgggaaatctatctttcccaacccatagcctctaatagacctacctgtgtagtacacattaaaggaaagaaattttatgggcttatggacatgggagctgatgtgtcagtcatatctataggatgggcacatcaaacattacaacgcatgttgaaaaaacaaaaagggggtataggaggccaactaccacctcaatcaaaactacatttagccttatttactttaaattttctgactcccggtatggatggtaagactccagcagaaagacattggcaagtgttagaggaaaaaagcaaagtttatctgaaagtgttatggaaatccccagaaggacaacaatggaaaggcccggtagatttactgacctggggaagagggtatgcttgtgtgtttacaggagatgggacaagccatgtgggtgccctcaaggtgcatgcgaccatggaatgggagactggaggaacccagggtggccaaccatgggcccagtccctcctgtacgagctatgagtcagctgagcctgagtgcaaagatggagagaaggccaaccagagtcatgatgacatcaacccccataacctggggacaactcaagaaaaccacacaggaagctgagaaactactggagtgtcagggacaggcaaaacccctgattccatgctcttggccatgttagccataatgtcctgtgcactacgttttccctgtgcacaggcaaaaacatattgggcatatgttcccaatcccccagcagtatggcctatactttggagctcactcctcctgagatttatcacgatcagggagagtgggctccaggacccctaactccccgtgacatagaaaagttagactctcagaacaatgtcattaattataccactccactggaaggactccctttgtttatcaccacaaagacgtcgctcagccatagctgtcttgcaattcaagctcaaacatggttgagtcactatggaaaaattatgtacttattaggtcttggttctattaatgtaactggtgtgctaaccaatcattcccagtccagtcaccctaattgtgctgattatacagaatggattccattcaatagttcctaccccactctgtggacccagtgtcttgatccactggctagtaaacaatatatgtcaactgaagacactgtggattgggaacctaaaggtcaattagatggaaaaggtgaaagtcagaaatcatggcacaaacttcactggcattggcggcaagcttttaatgcttcttctttatacaacagcagaatccaatcccagtctgctgctcagattgcttggcatggagcaggctttagcccacctcttcctcagttgcattatctggggaggaaaggaccaattcaagaaactatatggaaggcagcactcccatttatgaatggcaacatctggattggaacactgtctaataatagcaatagtaagcaacacagtcttaatgttgcatttgtaaagaatatcaccactcagtttacagtttgtgtttttaatccttatgcctttttggcagctaagaagaaccagcttcaggtaaacaatacccaattgacctgtaaatcttgccagttatatcacactgcattaatcatagcacattacgaacacataatatctctactttgataatgttgggttgcatccctgggctatggattcttgttaatctgtctgagccttgggctgccacacctgctttgcatttttgtaacacttcttctaactcagcttactcactgtgtccatagagccttaggcataatttttgctattgtttccttggtcaaactaataacttctgttgtgatatcttctgtaactctgcataattctattcaaacatctcagtaggtggagaactggacacgcacagctgaccaagcgaggctacttcagaataaaattaacactgagttacaaactgaagtggcaatgttgaaatccatggttctgtggttaggagaacaggtacaaagcttgcagttgcagcagcaattgcgtcatcattttaatcacattcatatttgcgtaactaactcagaatataaccaaagtgagtatccgtgggaccttgtgaaagcccatttgcaaggagctttcacatccaacatcacctttgatattggtgaattacaaaacaaaattattgatttaaataggcaaactcaagaatttcagccttctttagaagactggaccgaattccaggaaggcctggagagcctcaacccttggacctatctaaggcaccacattaacatcttatatgtagttcttggaataatgttgttttgtctctgtcttcggtttatagtctgtaaaatcggatggaccaccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccaccctcctatctcttttgcctaataaatacggagggctgtgtaaagctcagggcccttgtccactagaggtaaggtgctccctgaccccttctcccaaatatactcttttgtctcctgtctttattcccacgttcacccccatttgtgcagtcccatgggtccatgtgggttacggcccgccaccgcgcctggctgatttttgtatttttagtagagatcggatttcagcatcttggtcaggctggccttcaactccggatctcatcacacacccgcctcagcctccccacatgcggttattatagttgatatgtctgaaccaaaatgatatgggaagcttgagaataaaaggttggagacaatatgccacagagagagtaaccaaagataatctgttataactatatctcagacaaaactgaccagaaatcctaaagaattaacagagagaaagagaaacaatgctcactgaaaagaggtgaaatttggctcttcattcatagaaatacaccatatgtatacccctaacaacagtcttgaaatgtatacagcaaaaaatagaaccaaaaacaagaaatagaaaattcagactaaagactttaacagacctttcctagtaactgacagaacagaccatcaacaaacaaaataaaatttataaatgagaaagaaatgaatcttttatctgaggaatgtgactccctttaaattatcaggtctagagaggcattaaaatgtgacagcagtctttctgataggggttcccctgaaaaaaagaaaaaagaaaaaattaaaaactaaaaaaaaaatttaatgtgacaatagtcacatctcatttccccctcaagctaaataattatctcttaaagccacttgctatgtaggctctagactaactcacactgagtagccataaaatgccattcactggacatcctaactcataaaaccccatagttaacaatgtacagccaattgttaattgatattatttctgtaaaccaatgagaattcttgccaaacaactttatgtcagctcacggtttgttcccttttgactttaaaacctgtttctaacaaaatcctaacagagcacttaaccaaggcaacctgaaagtattttcccaggcagctgtcctcattttggctcaagtaaactctttaaaattgtattttgtgcagtttcctcttttaggctgacataaacgatatcatttagaagaactcgaatatatttttaaaattagatttactgagataaattttaacagttttaaataaatgcaaagatgtactataaagatgggctggaaaacaaagcattttaaaaatgtcaagtctcccaaatctacagattcaatgaaatcacagtcacaatcccaaactgatactgaaaagtttaaatagctataaacttttttttaaagtttgaaaaaaaagttagaagacttgccatatcagttatgaggacttataaagctactttaattaggacagcacaatattagtacaataacaggcaaataggacaaaggaacagaataaaatccttataagcagaattaagcacatatagagactcaatggcaatgatagcactacagggaagtagataaaagctgtcttttcaataaatggaactaagggcgccgtggctcacgcctgtaatcctagcactttgggaagctgaggaaggtgtgggggaaagagagatcagactgttactgtgtctatatagaaagaggaagacataagaaactccattttaatctgtacaaagaaaagttcctctgtcttgagatactgttaatctgtaaccctagccccaaccctgtgctcagaaacgtgtgctgtgttggctcaaggtttaatggatttagggctgtgcaggacgtgctttgttaaaatgtgtttgcaggcagtatgcttggtaaaagtcatcaccattctccagtctcaagtacccagggacacaatgcactgcggaaggccgcagggacctctgcccaagaaagcctgggtattgtccaaggtttcctcccactgatacagcctgagatatggtctcgtgggaagggaaaaacctgaccatctcccagcccaacactcgtaaagggtctgtgctgaggaggattagtgaaagaggaagacctctttacagttaaaataagagaaagccatctgtctcctgctcctccctgggaatggaatgtcccggtataaaacccaatcatacattctatttactaagataggagaaaaccaccttataactaaaggtgagacatactggcggcaatactactctttactacactaagatgtctgtgtaaagtcaaacataaatctggcctacgtacacatcaaggcacaggacctttccttaaacttatttataacacagagtcctttactcacatgttttcctactgaccctctccccaccattaccctatagtcctgccacacccccctcaccaagatggtaaaaatagtaatcaataaatactaacaaaactcagagaccagtgccggtgtgggtcccccatatgctgaacaccagtcccctgggcccacttttcttcctctgtactttctctctgtgtctgatttcttttctcagtctctcatttccaccttgcaaaaaatacccacaggtgtggaggggcaggcccccttcaggcaggtggaccacttgagccagagttggagaccagcctggccatcatggtgaaaccccatctctactaaaaatacaaaaattagccaggcaaggtggcacctgctggtaattccagctactcgggaggccgtggcacaagaatcacttgagcccagaaggcagaggttgcagttgagccaagcacgccactacactccagcctgggcgacgagagcaagactctatctaaaaaaattaaaaaaaaaaaaaaaaatcaataaatggtactggggatggggacagaaagttaaaacccccctcacaacatacacaaaaaccattttagaatcaactgtcaatttcaatggtagaaacatatcaataaagctttaaagaacattaatataggagaatctctcaatgttattagggtatggccagatattttaaagaggccacataaagcaccctataaagcaaactatatcctgctaggggaactgtaagtggtacaaccactttagaaaacagtttgacatctatttagacggagtttatacacactctatgaagcagcaattttcctccgaggtgcacatctagatatacatctctgcctcccccatatgagagcacatatgaaccaaaagacatttacacaaattttcacacatgcattattcttaataatacaagctttaggtaatacaaatgtaattaataatagaaaaaactgctatattttacataatggaatgtgatagaaaacctattatacctttggtccagcctgcaagaatgctttttacatttttgaaagactgtaaaacaaaaagcaaattagcatatgcaagagaccatatgtagcctgcaagccctaaaatatttactgtaaattcgcctgatccttgtcattgagcaaagaaaatatactcagatgcaacaggaaagaccctcaccaataatgagcaaaagaaggctgacacaaaaaaagagtgatgtacaattccactgatatacagagtttaaaataggcaaaactgtattaactacaatgataaataatgattaattatataaagaaaagcctaaaatacttttcggtgtgagaatggaaaaagactcacagaacaccactggtgtgctgaccatattctatttcttgacctgggcaatgactgcttatacatatattgcctccatgataattaaattgtacatttaaaatatataaatgtagaaaaattaacaaagtaaaggaagagatcaaccataccaaacagtttacctccaggaaaggtgttaactccagacaacacaacgggtgaattttacaggtgggtaataaaacaagaacgtccactaacaccctattttcctactttatactggaaagttgagccaatgcattaagataagaatgaattataagcattacaaagtaagacagaaaattaatgttattttcaggcgatatcatcacgaacatggaaaaagagattcaagaaattacatatttaaaaaagaaaatgctccctcagaaactcccaggcagattttcacatacatagttggctagaattgcaccatacgcctaagctcatttccatgtcaaacctatcactagcaatggcaattggaaccagcaagattggctaagaccaacaaggccttactaagaaactgggatttgggtcgccttgccacagggatgaatacttcacgaaatggagattctgttaagaaagtgtgaatataaggcgggcaagcaacactcactatatattaagaagtgaaggccgggcgcggtggctcacgcctgtaatcccagcactttggaaagccaaggtgggcggatcacctgaggtcaggagttcgagaccaacctgcccaacgtggtaaaaccctgtctctactaaaaatacaaaaactagccgggcgtggtggcgtgggcctgtagtcccagctactcaggaggctgaggcaggagaatcgcttgaacccgggaggcggagattgcagtgagccgagatcgcgccattgcactccagtctgggagacaaaagtgaaactccgtctcaaaaaataaaaaaaataaataaaaaataaaagaagtgaatgcagaggttggcaacattttcgattttgccggccacgaggtctctgtcacaacaactcaaccgctgcctttgcagccatagacaatatataatcggagggtatgactgaacttgaccccccgatctgtaaatagccaccccaaggatcagaagagtagatatatggtttcgaactaatgctgggggctgtgtcgccttttgccccagtaaccgaggttcgaacctcaacccaggacccagggctccaaagtctcgaaagcttcagccctcacaagcctttgtaccacagacactggccccatgcctcttactcatccgaaccacggaccagacactctacagcgatggacatcctcccagactccaacatcactgagttccaaattaaatcctgaacccgaagcagacgccgcatcgatcctaatcgccacctccatcctttacaagcagagtgatccataccttgacagttaggacacggccgttgatcactacagacccttagtcactgtactcacaccaaaggcacgcggaccacagacagggggatcacagactcccaccaggtacctcccaaatgcctataccccggcgctccccagtcttcctgccaaaaactatgtggtccagggtacaccacgtcctcagatctcccaaaccttccactgagacaaaacctgaactaggacaaaaaactttcagggacaaaaccacacactgacctctattttctccagatacacaagaagggcctcaacgttacacttccgtaaactgctcctacttctggagtcctcgcacgggtttatggtccacctacggcggccgaggagaacctaaaatgtttaaaagagcaaggacaagcgcatttacggcatttcctactctgtaaaatggccgcgcccatagccgtggctcctgacggcagccatgtttgaaaattggacgcacagaaggcagtggcaggtttttgagccaggagccagggaagaagagaagtcactgaaatcgcctcgtttcctggcacttaaagtcttgcgaaagggggcagattttcagagactcaggctttatcaggcaaatatggggcaagctaaattgcctttagcgcttttccatccactttgttaaatttaaaaaaaaaggttttgaaaaagacaagtaacagtgcagccaggtgtaggtatcccagagaatgaattggaaatggaaaaggtaacagatcaggtagaaagggaaaaggcaacacatcaggtaggcagacacccacgggaaagcgtctggcgaaaattagcttgcaggaagcggtttttaagaacagaaaaatagcaggtattcgggggggcgggtggtgaagaaagaaaaaaattataattttttttgagacggagtcttgctctgtcgccaggctggagtgcagtggcgagatctgggctcactgcaacctctgcctccctggttcaagcgattctcctgccttagcctcccaagtagctgggactacaggcacgcgccaccacgcccagctaatttttgtatttttagtagagactggctttcaccatgttggccaagatgatctcgacctcctgacctcgtgatctgcctgtctcggcctcccaaagtgctgggattacaggtgtgagccaccgcgcctggcctcgaaaaaatgattattatttacaaaaaagaagaagaagaaggaggaagaggaggaggagaaggaagagaaaagaggagaaaagaagagaaaagaggagaggagaggagagaaaagagattttgagaatgaattacgatgtgagcctggccacgacagactaaaggaattgggcctcctagaaaggccacttttagtaaaggtgccaatgggaagagcagagccagaattgagagtataaaaatattgttaagagtttttgacaaaagtgccaagacaattcaataagaatagtcttttcaacaagcggcactgggataattggatatccacatccagaaaaatgagttaggaccctcaaaccatacacaaaagttaactcaaaatagatcatagatctaagtttaagagaaagtataaaacttagagaaggaaaagggagataatcctcatggacgtgagttaattctgagaggagagtaaaggatgacccacaaaacaaaataaaattaataaagtggacttgatttttttttaagtttgtgcttctaaacacaacatttaagaaagtgaagtggggcacggtggctcacacctgtaatcccagcactttgggaggccgaggcaggcggatcatctgaggtcaggagttccagaccagcctggccaacaaagcgaaaccagtctctactaaaaatacaaaaattacccggacgcggtggcgcgcgcctgtaatcccagctactcgggagcctgaggcaggagaatcgcttgaatccgggaggcggaggttgcagtaagccgagatcgcgccactgcaccccagcctgggcgacagagcaagactcctcggtaaagacaccacttcgtcaccctgaattactctgatttttatgggtacaatgagaatagtggacctaggaagaaaaagtttttaaatagaaaccttcaggacagatttggacttgaaagactgacaggaagtgtttccagcatccagttagtctcaaagcaaccactaaccttcaactgcacacctgaaagcctccagcctcattacattctcaaacacagacaagccccgtcttcctctaaataaaattgccttcaaattcaatttaaaacttaccacagaggcactcctttgacactcctccccctagacctttcattcacgccactcctcttcctagctcgggcttctctgtatctgagccccatattaaattgcaaatctgagcaaaaaacagcattcactgagacacactttccccagttttctattactgagactcatgaaaagtgaacatatagacctcaagctctgtccgtgggaccctcagtcattaaactcttaaaactaagccttaacctttgacatcccaagggtctctttctcacacccatattcctcggtgactaaactgaaataaaacccctgaacacggacattcacatgcgtttccacttcatggtcgtccccacaagctccccatccggattcacacgcagcatcaggctttcaaggctacagtagcagctgccaaaggctgaacacgtatcagaacctacttccgattctggaattctggtgctgcaaccccatccttcgccatctctaagaacaccgagagactgggaggcgggcttccggagagggatatgggacatttcccaaagtccaggttctggctttgaacattttatatgaggtaacatagctgttttacctcatagagcatattatgtcatttctgatgggagtgaccgtagattattagtggagtgatagacacgcacatcaacagaatagagtcaagaaatggacacaagaacaggcaactgatttttacaaatgttcaaaatcaatttaatggaaagaggacagtgttttcaatactgttgaatcaactgggcaaccataggctgaactttaaattaacccttaccctatatacaaagatgaatttaaatggatattgctaaatattaaaaagcaaaactggctgggcgtggtgtctcacgcctgcaatcccagcactttgggaggctgaggtggccagatcacgaggtcaggagatcaagaccatcttggccaacatggtgaaaccccgtctctactaaaaatacaaaaattagctgagcatgccggtgcgtgcctgtaatcctagctacttgggaggctgaggcaggagaatcacctaaacccaggaggcggaggttgcagtgagccaagatcatgccattgaactccagcctgggtgagagagtgagactctgtctcaaaaaaaaaaaaaaaaaaaaaaaaaaaaagaagcaaaactacattattttgtcaaaggaagtggaaaaagaattatcaattacagtaaggaaggaatacttagatgtaatgccaaaaccccacaatccattaaaaaaaaaaaggctgggtgcaatggctcacacctgtaatcccagcactttgggaggccatggtggacagatcacctgaggtcaggagtttgagcccagtttggccaacacggtgaaaccccaatctctacaaaagtacaaaaattagtgggacatgatggcaggtgcctgtaatcccagctactcgggaggctgaggcagaagaatcacttgaacctgggaggcagaggttgcagtgagccgagatcatgccattgcactccagcctgggcaagacagcaagattccatctcaaaaaaaaaagttggacttcatcataattaaaatctttttctctgagagaaaaaaagaaagaaccacatctatggaaaaatatttgcaagtgatataaaacctttatccagctggataaaatctttatccagcattaataaacaatgctctaagcagcgcacagtggcaaatgcctgcagtcccagctactctggaggctgggacagaaaacttctcaagaccaggagtttgagactgtagtgtgctataatggtgcctgtgaatagccactgcactccagcctgagcaacatagtgagaccttgtctcttaaaaaaaaaaaaaaaaaagcctttagggaggtgcaaatggaaggccacatacaattggtatgtttgtattcataccaatacacacacaatagaataggtaaaataaaacattccagtcctgcgtggtggctcacgcctgtaatcccagcacttcaggaggctgaggcgggtggatcacaaggtcaggagttcgagaccagcctggccaagatgatgaaaccccgtcactactaaaaatacaaaaattagccaggcgcagtggcaggcacctgtaatcccagctactcaggaggctgaagcaggagaatcacttgaaccccggaggcagagggtgcagcaagccaagatcgtgccactgcactctagcctggtcaacagagcaagactacatctcaaaacaaaacaatacaaaacaaaaaaaatactgacagcatcaagtggaagaatgtggagcaactgaacctttctatatattgttggtgagcaatgaaacaccactctggttagtatcttacaaaggtaaacatacacttaccttatgacccatgaatcatactctgcagtaattatcctagagaagtaaaaaattgtgctcacacaaagcctgtgtgtacaaatgttcataggatttttatttgtaacagtaagaaaaaccgggaacaaaactaatgtccttcagtgggtgaataaacaaatagtggtatattcgtatcatagattattagtggccaataaaaacagaacaatgatatgcagaacaacttggatggatttcaggttaatctgctttagttgaaatagccaataccaaaagggtacatgctgtatgattccatttttataacatgctactaatgacaaaactaaagatgaaaagatttctgattgccaagggttagggctgaggagaggttgtgactataaacaaggagcatgagggagtttgcattgatgcaacattctgaatctcgattacggtggtggtgacatgaatcaatatatgtgttaagatttcttaaagctacatataaaaaacaaacaaaaatgcatgcatgttaaaactggtgatttccaaataaattctgtagttaacagtattgtaacaatttcactttcctgtatttggtaatgaactatgcttatgtaagttgttatctttggaagaagctgggttaagggcaagaactctggaatattttggtaagattttgtgaatctaaacttatttcaaaataaaaacttacaaaaacatcttatttatattaatttcataacacctgatgttacttataaacttaaacatattcaagtatggtcaattacacttatgaactgaatatactgtatccagtttcattctgaagtactttagttattctgaaataacacaaacttagaaccaaagaaatgcaggagctaatcatataataaaatgaggcaggcataaaatactccggtattatatacaatattaaattttagttcgtgattagaggaagtcacaatttaaaatgtataaaatcagtgacaaggcaactaggaatatggctcaagctatcctgttcccaaatgcacatgaggcatattatctgttaaggttagaattgtgacagaaagctctcatccatcattttgccaaggcttctttccttcattaaattctctgatattttcctaaaagtcttctacattgaatgttttcataagttttttctgcattatttcctagcacacgatgaggcaaaacattttactgaaaaccctgccacaggggtttgccagaggaaagtatttctccagtgtgaactctctcaatctgttgaagttttatttttgggcaaagacgttcctataattattacatttccacgaattagtagtttattcatgatctatgatcacttctgagggggtttatcttcccaccaaaggcttttatagtctgccacattcataggatttttctcagtatacaatttttagacataatgtcctaaaatattttctcaaatgttttgtacatgttttctctgacacaaaacatgaagtaactgatcactaaataaacaaccatgtagtctgcattcatgaaattactcttctttgcagatatcttaagggcctacatctggcaagaggctttcccaaaatgactacctgtgaattctcctgtgtttaacaaggatagacaagtgcgcaaaagctttcccacaatcactacatccatagggcctctctcctgtatgttttctttgatgaacattgagccctgattttgtagtgaaggctttcccgcagtcactgcatttgtacggtttctctcctgtgtgaattctctgatgtgtaataagatcatttttgcgcaaagagaattttccacattcagtacatgcaaaggaagtctttcctgtgtgaaatcgctgatgttgtatgaggcatgtcttcttcctgaaggttttatcacattcattgcatttgtatggcttctctccagtatgagtttgctgatgtatactgagagtactcttcatggtgaagccctttccacattcattgcatatataaggtttctccccagtatgagttcgctgatgtgcaatgagcatgcttttcccagttaagcctttgccacattcactgcatacatagggtttctctcctgtatgagtgcgccgatgtacattgagatgactcttctcagtgaagccttttccacactcattgcaaatataaggtttctctcctgtatgagttcgttgatgtcccattagccggatctttgctggaaagccttttccacactcaccacatacatagggtttttctccagtatgagttcgctgatgcacaataaggcggctcttcacagtgaagccttttccacaatcattgcatatatatggcttctctgcagtatgagttcgctgatgtacaatgaggtcactcttcatggtgaaaccttttcgacattcggtgcatacatagggtttctctccagtatgtgttcgctgatgtctgatgagtgggctcttcaaagcgaagccctttccacactcattgcatttataaggtttctctccagtatgagttcgttgatgtaccatgagacagtgcttcattgaaaagccttttccacattcactacatgtatataatttctctcctgtatgagtttgctgatgtgtgataagactgttcttcaaggtgaagcctttcccacatttattgcatataaagggtttctcaccagtatgagttcgatgatgtgcagtaagacgcctcttctcaatgaagccttttccacattcactacatatataaggtttttctcctgtatgagttttctgatgtgtagtgagactgaactttgtagagaaggccttcccacatacactgcatccatggggtttctctcctgtatgagttcgttgatgataaatgagccgacacttcttgatgaaggctttcccacattggctacatgtgtaaggtttccctcccatatgagttttctgatgtatattgagctgtgatttcttgaggaaggttttgtcacattcagtgcattcataatgtttcagttctgtatgagttctctgatggtccattagtctggattttctggagaaagctttcccacacatactgcatacatgaggtttttctccagtgtgaactctctgatgatcaataaactgagacaacttgaggaaggctttcccacattcactgcatacatgggcattctctatgttgtgagttctctgttgcttaatgaactgggacttattaataggttttgcaattgcaggaaacttcatttcagtataaaattgtttatggttagcatgaaaaagggatttcccatctctattaaactcagcagagttctttaggccagagctccttttctggttttcaaaacttaaatttgattttaaaggtttttcatgtaagtcaaacgtatcacaatcttgcttcagcaggaaatgacctttgttctgattaacaatatttccaaacatattctgttcatggcactgtttcacactcttctgaatactttgattttgcaagtgatgctgcagaggatcatcaattttcctgatttctaggaaagaagagaacagtcaatcactccatcatcttgttttgaaataaactatttaaactattttttaaaactgccttggtgtgaggtgactctttagtgaaaaccctattttatttatttatttttttgtgagcaataaagctttttaatcacctgggtgcaggcggactgagtccgaaaaaggagtcagaaaagggtgataaggggagggcagttttatagcatttgggtaggtagtggaaaattacagctaaagggggttgaaaaccctattttagtataaaggaaactccatgtataaatatccctcatctcttacacattgggagagatgtgtaagattccttttatctcttacacataaaggaaattccatgtataaatatccttcatttcttacaaataaaacacaataatataaacacaccgaaaagtaaaagcaactgtacaaacaaggctagataattcacaatgtatatagatttggctgctttctaaataggtctttatacaatacacacatagtcaaatataaacaggtcactttttgcagggaaccccaaaatttggcaggataccagaccacagaaataaagagaaatatcagaccacacaggttgatcccaaatgacaaaggctgtattaatttattctacaaatgtttgctgaatgacatctatgtgtaagtcactatgctcatgtttgggatatacaaacaccttcctttttttttttttttttttttgagacagggtctctgtcaccaaggctggagtgcagtggcacaatctcagcttacttgcaactataacctctccctcccaggctcaagtgatcctcccacctcagcctcttgattagctgggaccacaggcatgtgccaccacacccagctaattttttgtatttttggtagagatgggtttttgctgtgttatctaggctggtctcacaagctcaagaagatccacctccctccgcctcccaaagtgctgggattacagacatgagccactgcactcagccaattttcacgaaggtttaattttagttaggaaaaaatgaaatcacaaggaagcaaaaaaataaagaaggtaattgcattttgtgaaatgtggttaatggaacaatggagatataagaggtggagaaaatcaagatatagttaaagaaatgacaaggttcactaataggttcaatgggacgagtgaaagagggttaatggaagtgaggactcaaagattattccaaaaattatatggtttcaggctggatacagtggctcacacctgtagtcccagcactttgggaggacaaagcgggtagatcacatgaggccaggagttcaagaccagcctggccaacatagtgaaactgtgtctctactaaaaatacaaaaattaggcatggtggcacatgcccgtagtcccggctacttgggaggctgaggcacaagaatcgcttgaacccaggaggtggaggttgcagtgggctgaaatcacaccactgcactccagctggggtgacacagcaagactctgtctcaaaaaaaaaaaaaaaaaaaaaaacgcaaaactatatggcttcagccattggataggaagaaaaaacctcatgatgaaaataggaatattactatctggaatgaagggaaaaatttagcatgccttgtgaaacacataaagtttaagaccattaccacatatccaagtacaaacatgaagaaattggttgaatatataaatctcgaaaaggccttatctggaaacagcaatgtagatgacatccaacatttacaaattattcaaagaaagagtactggatgagactttagttggaaacatgtagaaaaaaagaatgaaggcacagggccagggatcttgtcaatccaacatgtagagtttgggaattcgttaagtccactgaaatgaaccatacgctgactattatgatcaggtgcacaagtggagacccaggtgtacaaaacaaacatctaggagtggtaagaatgtaatagcctcttgaaaattgctaaaatagattttaagtgttctcacaaaaaaagtaagtacgtgaggtagtatatacattaatttgttcaatttagccattccacaatgtacacatatttcaaaacaacatgttttacatgataaatatatgtattttttatttaggaattaaaaagtaatcatgtcctggtgtggtggttcatgtctgtaatcccagcactttggtagggtgaggcaaagaggatcacttgagcccagaaatttgagaccagcctgggcaacatagtgagacctttctctataaaaaatacagaaattagctgggtgtggtggcatgtagtcccagctaggctaaagtgggaggatcacttgagcccaggagattgaggctgcagtgagccatgattgtgccactgcactccagcctgggtaacagagtagaaaaataaagaaaagaaatcataaatttaaaaaacagaagaatgtgagatcctcagcatttgatttaaagtgtcacatgctgagtgattatcacattccccaaacttgctattcttcttcattctatgtaccaccattaaactaattttcccaaagcacaatctcaagtttagatgaaaggttctatacttaagactccaactaatgacctaactggatcatactatcccgtgttgctacagaaagagggaacaatgatttgcagcaaagtgttaactcagcaggcctgggctattccatccctacacattccaaagaaagaactcgtcttaactgccttctaaaagataacctctgagcccctggaatattctgcctgctaagggtatcttttaatgcctgaggccttgggtcatatcagatagtttatgctagcaatgtgatttatggtggacacctggttttgcatgtctcaggctttgggccacatttgtattgttttgactctgggtggctacagacactgggcttagatgagcttccctagttggcaataacttcacatgtgttgacaaacactgttgcagggaaaattcagcactttgtgcaactccactagaacaggagaactgaaagcttgcacccagtttctcctggattcttctttctatactttttatctttgatgattttaatttgtattatttcactgtcacaaactgtaatcatgagtgtagcagttccctctcctccccattaacgtctaccttctacgtagcaggcaaagtaatctatcaaataaattagttatatcatgtcacttctctactcaaaactccctactgtgttctcaactcatttggaataaaatcaaggtcatgaatgcccttgacaggcagtatgtgacctctgtaccaaaacttccaactatgcccccactgttcttatttccagacagttttgcttttgctcactctactctatccattcaagcttcctagaagttcctcaaacacactccagggtcatttttcaacttctcattgtctcacacctggaacactcttcatccagggagcctacacgtgttcatcatctatctgctcaaaggcaccttaacaaagagctgttcccaccctacaagcacagtgccaactcctaacacttactgttccaccagctgctttaactttccttatagcaatttttactccaagatatgttatttatatatctgcttattactggttatatggttacttctaagagaacaaaagcattgtgaagaataaggacatggtatgttttttctttcttatttgtactgctgatagcgttggaatatagtaggctatcaaaacacaagttttgggtgtgtggtggaggcaggggggtttgtcatccagcctggagtgcagtggcatgaacttggctcattgcaatgtctgcctccagggttcaggcgattctcccacctcagcctcctgagtagctgggattataggcacataccaccacacccggctaatttttgtatttttagtagaaacggggtttcaccatgttggccaggctggtctcgaactcctgaactcaagtgatccatctgccttggcctcccaaaatgctgggattacaggcatgagccaccgcgcccagcccaaaacacaagttttaaaggaaggaatcatatgacaagaaacatgattaactgggactaggtgtcatcaaaatatgatagaaaagtaattaatgttatttctatattctagcaatgaataatctgaaaatgtaatcaagaaaacaattccattaactgcagaaacaaaaagaaaactatacttaggaatatacttagcaaaggaagtaccaaatttatattctgaaagtgataatgcattgtcgaaagaagtcaaagacctaacaggatataaaactgtccagtgttcatggatcagaatacttaatatgatgaaaatgggaatactccccaaaattgttacacagactcagtgcagtacctaccaaaatcctagccactctttttgtagaaatttacaactgattctaaacttcaaatggaaattcaaaggactcagaatagtcaaaacaaccttcaaagcaaagaacaaagatggaggactcacacttcccaatttcaaaacttactatagaaccataatcatcaagactatttgataatatatatttatacatagtatatgttccaaaattgattgtggtatggttacacaactaggtgaatagattaaaaaccactggcttatacaccttaaatgggtgaaatcatgtgatatgtgcattgtatctcaataatagtttacaaatatgatgaaaaaagcaaaagctatacagaaatgaatgcagtcaaaacatctaacatgaattaaagaaagttcagaattagcaaaactatgaaggaagtaatttgcagcaggcataaatgtctgatggtttgggctagaaataatatacgatattaaaagatcttttctaattaatcaaaacattatcttaaagtagagaactttaagagagttcagcatgtagaaaacacttaaggtaatgccagaatttaagatgtgcagtaatgaaagagaccctggatttaaacaggacagcctgcagcacgattcacaacagcaaagacatggaatcaacctaggttcccatcaatggtgaacaggataactgtggtatatatacaccatggaatactacaaagccataaaaaagaactaaagcatgtcatttgcagcaacatggatgcagctggaagccattaccctaagtgaaataactcagaaacagaaaaccaaatactgtgtattctcacttgtaggcaagagctaaacattgggaacacagggacatcaagacaggaacaatagacactggggactccaagaggaagaagggaggaaggcaagggttgaagaaccacctatttggtactatgttcactacttgggtgacaggattgagcttctagtgaatcctcggcatcaggcaatatatccatgagacaaacctgcatatgcacctcctgatgcacctcctgaatctaaaataaaaacataaaagataaaataaaattaaaaaaataaaattatataaggatagccaaaagcattattcttagagggaagatgattcttgttcctcatacacaaaatgggaagttacaggctagttgtcatgaagacaagtaaaatacatggaaataaagtatacattagataatattaaggcagaagttaatttggtagtctcttccagagaatgaagagttaattcacgggaatgaaaaaaacttttaaaagttatgagaacagtaaagaaaatggaagaaggatgggctgggcacggaggctcacgctgtaatcccagcactttgggaggccaaggctgacagattacttgagccaaggagttcaagaccagcctaggcaacatgacaaaaccccacctctataagaaatacaaaaatcagctgagcatggtgatgtgtgcctgtagtcccagccacttaagaggctgaggtgggaggatcgcttgagccgaggaggtcaaggctacagtgagcctgggtgacagatgagaccttctttccaaaaaaaaaaagtatggagaaactcaggattcagtataagaggaataagagaacttaagaaacacataaatgccaatcagagaccaggttatcatgggcacagcatccagagtggagaaaatgagggaaaataatgattcccagagtgggaataatgaaggaaaattattattttcctactagggcaggaagatgcagtagtcagaaaaaagtaatgagttcaaaggtctctctttccggagaggcctggaaaatggaatttcatagcaagagaggtaatacacaagcagagacactgtgacagtggacaagaaaaggcagatttgaaaatcctaagaagataattatgtagacaaaaacaagatgtgcataaaataaacaaagatgaaatctcaaggaaaaaaagtgggggccgggcgcagtggctcaagcctgtaatctcagcactttgggaggccaaggtgggcagatcacaaggtcaagagatcaagaccatcctggccaatatggtgaaaccccgtttctactaaaaatacaaaaattagctgggcgtggtggtacgcacctgtagtcccagctactcaggaggctgaggcaggagaatcccttgaacccgggaggcggaggttgcagtgagccaagattgcgctactgctctccagcctggtgacagagcaagactccatctcaaaaaaaaaaaaaaaaaaagaaaagaaagtggggcatattttccatactataacaaaaaagagctcttccttgggaagaaggagtgatggaggggctgttgctgtgtcctcagatgccctcactgctttgacgcctgctctgtgtgggcagaacatggtgtctgtggctgtccacctggctgctcctctcactcaccagaacagattcgagagtagatttcatcttctgttgtgcaagtttcttctcctcgttccaatttggagagtgcatctggtttgctggcttgataccctgttcatgggaaatgacagaagatttagacaaatcaaacggggctggcaatattgaaaaaggagagttacattttaaggactacataggtatcagatctgtaacaagaaggtagattatactctcttgtgtggggcaagagaatgatgtgagaatctaccacttcagagtactgcaggtaagcagctgagaaaggaaggccactgactgggcaccctctgagtgacacagggcagctgtcctcacccactgccaccaggttgctgtagttctccaacatcacgtcccggtacaggtccttctgagcagggctcaggaactgccactcctcccaggtgaagtccacagccacatcctccagtgttagggattcctgtaataacacacttctgtttaatgaagtcatattcttttggtgataggaaaagaatgtcaaggaagtcattccgctcattttcaccacataggaagctggtggggtttttttcttagtacattttgacagaataagaattccagtaaaatattctgtaactgtgcggtcatccattcattcaacaatgttgaaaagtcaaagaaatgtctgtaatacacagctatccaatcctcttgctaatgaaagaacatctataacatgtagcatctatttcccaataccaaactagtcataagtatatgccagttacaagtagacgaataattcagattcttaaattcactatgagctttcaggccaatatcaaactctgtaatgaagacatggcagatgctagtatcacaagacaatgcattctaaataactatggttaacatagttaaccatattattattttattctgaatgaaataaaagagactatataaaacatgtataaagcacaaagattattagatgattaaacaaatctgtttttttgcttgcttgtttttttttttgagatggagtcttgctctgttgcccaggctggagtgcagtggcacaatctcggctcactgcaacttctgcctcccgggttcaagcaattctcctgcctcagcctccctagtagctgggattacaggcgcacgccaccacacctggctaatttttgtatttttagtagagatgaggtttcaccacgttggccaggctggtctcacactcctgacctcaggtgatccacccgccttggccttccaaagtgctgggattacaggtgtgagccacagcgcctggccatgattaagcaaatttggaaaaaaaaatccttagaatatatatgcagacacatgtatgcacacagacaaattcatatatatgtgtatgttattagacagcgttaataacattaaatacaatgaagaaacagctaaaagaaatctacttttgcatttatgagaaggctacagttaagaacaccacctaccataacacctccgtgaagaactatcaaagatgtatttgagcctcagaattataagccatgaaacattaacatccctcaagaaactggtctgctttctcacagttgatataacttatcatgtttctcttgtatagcttgtcagagatactagaggcaagtttacagcaaatgtaacctacggggtcccacacagtcacaaattccaacatgaatcatgtagtatgaatcctatgaataatatatccctgatccttctttgcccagatttctccaggtcctgatatttccaatttatacttttctgattaattaccctgatttttacaggactttaaaaatacattggagaataaaggaaagaataaaacaaaccaaaagtcacctgggcctgcatcattgtctcctaaatttgggaaatgactgctaacttggacgttctgtatttgtctcttctgaatcagctctaaatttcggttcaaaaacttcaatctccaatcaaggatgtccccagaaatgatgacacccaagtcttggaaactccgcctccttccttcacttgatttctcttgttctcagcacctgtgggctgaagagcaaattactctgagtggtacattctttttaggcccagatgttgtcactgttcctatatgctcaccttaaatcaaggcccccaaatatctctctgttcttttatttagtgctccagaagcttttatatctgggctagtaaaatataacattctgaatatatgggaggtacagcacccttctatataaagttgacgtggtatgactactgctagtaagtgaaagagaatgtggggaaaagaatcgtcacaacgtgatgcccagcagctgggcaatcctcaggcagaccagttttaggaaagaggtcacatagacagttaagatgcacacattttttctttaaaaccatgtgtacccatctaccttttcagaggtctttttacattctaggatactgcaatctgagaacactgtcctaagcaaataataagcactatcttatttaaattattcattaccatccacatctttgactttttttcttttttttttgagactgagtttcactcactctgttgcccaggctggagtgagtaagactccagtggcgtgatctctgttcactgcaacctccatctcctgggttcaagcgattctcctgcttcagccgcctgagaagctgggattacaggtgaacgccacatgcgctgctaatttttgtacttttagtagaaacggggtttcaccatgttggccaggctggtcttgaactcctgagctcaactgatccacccatctcagcctcccaaagtgctgggactacaggcatgagccactgcacccggccgccatccacatcttgatacttgcaaagtattctaagtataaatgtataaaggatactcagcaaaaatatccttgaggaattacatattacagcaaatcctaacggatattcttcaagcaaaagaaagatgactccagtgtaagcagaggagcaaggtctgaagaggaacaaaacggtaagtaattaataaagcctaaatcagtattgactggaaaaataatactgataataatatatcaggaagttttaatatatatagtgttaaaatattccataagaacatataggccgggtgcggtggctcacgcctgtaatcccaacactttgggaggccgaggtgggcagatcacgaggtcaggagttcgagatcagcctgaccaacatggtgaaaccccgtctctactaaaaatacaaaaattagctgggcatggtagcgcgtgcctataatcccagctactcaggaggctgaggcaggagaattgcttgaacccaggaagcggagggtgcagtgagccaagattgtgccattgcactccagcctgggtgacagagtgagattctatctcaaaacaacaacaacaaaaaagaacatataaagtaggaggatggcaaatgaaaacgtattttaagatatctgcatagcagaagagtataaaatactaattaccataacattaacaaataagtttatatgttgtttgtaatcaatagtgtcagcaataaaactaatttttaaaaaattatttccatgttaaaagagaggtctatggtttccgtggcagctactcaactctactgttgtagctcaaaaatgcccacatacaaaaaaatagacaaatgattgtggccaggtcccaacaaaactttattaacagaaacaggtgctgggagatttagtccatgggctctagttgcccaactgtgaatttgtgcagaaaagccatatggtcacctaaatcaagagtcagtaatatagtatccaggacctggaccacctgttttgtaaataaagtcttataagaacacagctacatgcattccatgacatttcatctcaggctattatcacattacaatggcagagttgagaatttgggtctagaatgtcactcagtagaatgcagtataaaaaaataatcaaagatgacttttgaatataaggggcaaattatcagtatttgcctaatacgtctgtattcctttagtcaggtggctggatacaaaatttaaatagaaaaatcctatatcctcctaaagcatatacagatcgagtcagtattaagagcagaacctttcttgggaacaatttaacattctattgaaaattgccaataaaggtatacctggtaacccaaaaccccattcctaaaactttcttaaaaggtaatattggcaaaagtgtgctatctgacaggtcatttttactttcttcacttgatttttcatagggaaaacacaggtttacatcagaaaaatattagcattctacatttaaaataaaattgctgatggtagttcagtaatataagtttacggctttaaatgttttcattaatagaaaaaagagagaaaccaggcgggaggaagggagagaaaaaaatgaatataaatacaaattttacaaaagacaaaaccaaaaataatcctcagagataatcgtgaggaaaagatgtttaactcctcttttggccaacaagtaaagcgacacaagttatgccaatcacacaatgagcaagaagcagaatcagggctgaaaatccacttttgtttcacttcaaaatccacttttactctactttataccgaaccaaaattatctgtaaatcagatgcctccctattaagtaaataaataaagcaattaaagggctattagtagaattctagttaatcatatacagaattatttagaggaatggtacttatgtctgtaacttactttgaaatataccaaaatcgacaacaaataaggaatgattcacaaacagaggaatggatgaatacttagaaaaccagtagagctgatctaatacaatgttaatggtaaaagctaggtggtaggcatattggtattaacattaaacttctttcaatatttccataggttcaaaaattttcacaaaataatatgttaggcagagagaaaaatattgtaatactaagaattaagatgaccaaatataaaataaatatttaaaattaatttatcttttgttatagattataaggaaaggggagtcagaaagcaatacactgcaataaaagtaatagtctagattgaagattaaaggcaggaaaaacaaaattcatggataaatggataatcataaaatgttcctaaaaataatacctaaacattttaaaacatttcacttctatccaaatgtacgcataaacttaatgtgaatgcacttatagtaccaccggctcaaacagtaaaaacaacttctaaatgtttattacataatataaagcgaaaaagataatagtaccatttacataatttatctgaattatgaatattaagcacataacatacacgtctaaaattgaaatattctgaaaatttgacaaaggttatctttgagtaaccgagcttaccatggcagagatgttatcttacttgtgtcagaaagaacctgaaaagaaatatccaagaggatacgctggaaacttgcaggacaaagggtagaagccgcatcttaaatataaaacatactacttttaggtatgctagatgactgatctcgccaaaaacttccatttctgaggattcaagaccaaggggtgatggaaggtgccaaaggggatttaaaaaccagtcgtggagaagggtcttgggcagaaggggaatgctaatgagcatcaattctgttccagcagccagggctggggctaacccatcacctgccatggttcccaggcctccagagctgcagcccacatcggaatctgtggcgctaccaccaccgccaccgggattaattccaaaacctggatcagaaacctccgtaccttaacccccaagacagttcctcaatcatttagtcccaaacaaaacctgaaccataaaccgattcgctgacaaaacaaaccctccagttcgcaatcactgagccccgccaaaggacaacaccaaagacaccagaatgtgacttgggcactcagtagcggatctctagagatctttaaccacaaactacacgaggaccctgtgactggtcccagaggtaccccgatcacacacacacacaccctatcacggacctcttgtagttcccctgcgataggaatcggacccacgctaagctcctgaaagaattccactggcgtcgccaaacgctggcgccgacagataccagtccatcaccactgtccacgaacacgcccagccacggacagaatttcctcccccgtcaccacagcgaccacccagtgactgaacttacttcccagaacttggtgggctccggcctcatctctcggcctcctcagtgcctgacggcgactatccagggtcggaggcgttcccagcgtttgcgcagatgcaagatggccgcgccctcgtcgccttggctccatgggggccgccatctttgagtatctgacgtacacaaggcaaagggcgcgttttggcgctggtgaccgggggtgaccgggggtgaccggggatggccgggaagatgaaagagcactgaaactgtcccatttcctggcacctcaacccttcataaatacgggtccatatacagaggctccagtttacacaagacaaaaatggcgtggaggtaaatccctttcagcagctgaatagaaggctaagatggccgcgacgtttacactttgtacaaaggttaggaaacagttccttgtgagggaaaaggagaaccggccgagaggggacacttcggccaaagccagatttctaacaaagtagcttgaagcgccttttgaacgcagaagagggctgttagctacgctgacggaacaggggtagcagtcacagactaggtaatgaaaacggttggaacgtgccaaaattatgttgggtgaaaggcatggggaaaagccagtaaaagccagaaagtatagttcccaaggcggaggggagagcctgggacccaggtggagccaaatatgagggctggactcaggagaagtggccagaaattaagggaacaggaccacttcagtgagaaaaaaaaggttgggaaagaggccgggcgcggtggctcacgcctgtaatcccagcactttgggaggccgaggtgggcggatcacctgagagcgggagttcgagaccagcctgaccaacatggagaaaccctgtctctactaaaaatacaaaattagccaggcatggtggcgcatgcctgtaatcccagctactcgggaggctgaggcaggagaatcgcttgaacccgggaggcggaggttgctgtgggccaagatggcgtcattgcactccagcctgggcaacaggagcaaaactccatctcaaaaaaaaaacaaaagaaagaaaggttaagaaggagatcacgttatactacgtgtgccaaccgcgaatagtatgtgcaaagtcatggcaatgctgaactgtaaatataaatccaaccaaacttcctatattagaagaatgagagaaaggaaatgcctgtgtgaatctatgtgtgtgatataggtatcagtatataaatatacagagaaattgtcaaactatttttcagagtcaagttcgtgttccatttgctcttctcacccttggtatatgagagtttttctttttttttgttttttttttgtctctttttgaggcaaggtccactctgttgcccagtctggagtgcctggggagatcacagctcactgtaacttggaactcctgggctcctgaatagctgggactacaggtgggcaccaccacacctggctaattttttaattttctgtagagacaagggtctcactatgatgcccagctggtcttgaactggcctcaagcagtcctcccacttcatcctccaaaagtgctgggattacaggtgtgagccacttcacccttcacccggcctataaagagatctgaaaagaaataagaaaaaagatgggcgcggtggctcatgcctgtaatcctaacactttgggaggccaaagcgggaggattgcctgagttcaggagtttgagatcagcctggccaacatggcgaaaccccatagctactaaaatacaaaaaaaattagctgggcatggtgtctcaggcctgtagtcccatttacttggaaggctgaggcacgagaatcgcttgaacccaggaggcagaggttgcagtgagccaagatcatgccactgcaccccagcctgagagacagagtgagactcttgtctcaaaaaaaaaaataaataaaaataaggaaaagatgatcaacttaaaagctccctaaaattttctataaatacatgaaggaaataaacaggacactttttttaatgtaaatgatcctaaacaatttaaaaaataccagttttactaatattcaaacaaatgcaaagtaaacgtgaaatataaatgttttaacccttattaagatttgtaaagattgaatgacaaatcatatttagattataaggccatggaacaaaggcattctgttatgctaagcctctttaagtcttctttttctgcatggtaggtaataatgttgtcaattacatactgctttaaatgaattgagatattatcatactggtcataattcgaagttcttaagcattacattatttctaggtataggattgtgtttctatataaattcgtaaaatgtttttgtagtacagtctgttattacccagtttaaacttttccttctccttgagccatgaattttaagaattgattcaatagaacttttctttgtgagaacaaatatgtgcaaggatatttatggtattgatctgacaattataaggaaacaaatacttttgtggttattgcataaatttattcttgcatctctatattcacatctttggatagtattctccatagtgactgactaatgtgtccaataggacagtagcaagtgtaacacaaatggaggtgagaaataagcttgctcatcaaggcttgcttgtctcttagagatcttccaacacattgtaagaaagcccagactagcctcttgttgactgtgtaaataaaggcctcatccattccagcagaagcccaaatatgtgaaaaaagctatttagaccatgcagccccagtcaaaatccaaccactagagcctccggcccagcagtcccaattgttactaaactctgtggacaaacataatgccatgagtgggtgggggtcacctaatctgccatccaagtgcttatccctgctcctagccaagcaggacttgccagcttgggtggtgtccaagtagggaggggccctcactcttggatcaccataagagttgagacagctgggtctgcaggacattggaaaagtcgggtgtgccttcctctgtagggccacctgggaaggatacagctgtctgcaaaccatgatgtctgcctgagggagccccatgagcagaggatgcccaaggccttgggaacccacgccttgcactagatttaatgactaccctgctgggttttgaacttgcatggaacctatagccctttcttgtggctttctcccttttggaatgggaatgtttacccaacgtctatgcccccattgtatcttggaagcaaataactttttattttacaggctcataggtagaagagacttgccttgtctcagataagactttggacttttgagttaatgctggaatgagttaagactttggggactcttaggaaggcatgatggtattttacaatgtgaggacatgagatttgttggggagggagaccaggggctgaatgatatagtttggatatttgtccctgtccaaatctcatgttgaaatgtaattcccaatgtcagccgggcgtggtggctcacacctgtaatctcagcactttgggaggccgaggcaggtggatcacaagaccaggagatagagaccatcctggctaacatggtgaaaccctgtctctactaaaaatacaaaaaaaaaattagctgggcatggtggcgggcgcctgtagtcccagccactcgggaggctgaggcaggagaatggtgtgaacccaggaggcagagcttgcagtgagccgagatcgtcccactgcactccagcctgggagacagagcgagactccatctcaaaaaaaaaaaaaaaaaaaggaaatgtaatccccaatgttgaaggtggggcctggtgggaggtgtctcagtcatgggggcagatccctcatggcttgatgctgcccttgcaatagtgagtgagtactagcaagatctagctatttgagtgtgcagcacctaccccctccactctgtcttactcctgctccctcttcaccttccaccatgattgtaagcttcctgaggcctccccaggaccagatgccagtgctatgcttcctgtacagcctgtagaatcataagccaattaaacctcttttcttataaattatccagcctcaagtatttatttatagcaatgcaagaatggcctaaaacatgctgtctctacaaaaaaaaaaaaaaaaaaaaaaaaagccaggcatgagggtgcacacacatagtcccacctacatgggaggctgacgcaggaggaacacttgaacccaggagtttgaggctgcagtgagctataatcgcaccactgcactccagcctaggcaacagagactcttttttttgttgtttttgtttgtttttcagacagagcctattccgttgcccaggcctggagtgcagtggcaggatctcagctcactgcaacctctgcctcccaggttcaagtgattcctgcctcagcctcacaagtaattgggattacaggcgccaactgtagagcgcccgatcctgtcactgtttggggcgccactacgtaacccacaaggacctagggggactgaaaaaagtgggggaaacgggaataaaagagacaaaagagtatatttggaagaagggatcaggggacaccttgcctctagtggacaagggccctgagctttacacagccctccatatttattaggcaaaagagatagtgagaaggcgggtggaagaaggggtcagctactcagtccagagtagggtttgcaagatggcattctctagatgtcccagtagataacctcaaggagctcagcaccaggaagcgattgccctcagcaaaccttctggcagcggaagcagtcatgagtttgcccacatcgtgcattcatgataaagtttgctgtttgatcatatagcctccagtggaatgctgagttggtcacatcccatgggccttcggctcccaacagcccagcaccatacccagctaattttttgtgtgtatttttagtagacacagggtttcgccacgttggccaggctggtcttgaacttctgacctcaagtgatccgcctgcctcggcctctcaagagaccctgtctcttaaaaaagaaaaaaaagaggttaagattgtaaatcctaaaaaaaaaaaagcaaaagcaaaagctgtatgtagatttcacagcatctttatttatagcacttaaaaccaggaaaacagtgcaaatatatctcataggtgaatggataaactactacatcaaatatgtatactactctcaaatataaacaactttcatctggttagatacatggtggtaaaaaaaaataataaaacaactattcatcaactcatataaaccttaggagtaatttgctgagtgacaaaaatgccaaaagcttacatactctctatcaataaaaattcatataacttatttatataaaatttataaaaaccatttacaaaaacaattttatttttatcatattcatgaaatgatgaaattatactgataggagaaaagtggttggcagagttaggtttggatggagtgtaagcataaaaaggtagcatgagggactttgtgttcattagttttatgtggttgcagtggttacacgaatctgtacatgtaatacaacttcttagagtacaaactaaaaaagaaaaaaacatgtaaaaattcgtcaaatccaaaataagattagtactttatagtatcctaccaatgttgtttttctggttttgataattatggttatataggatatttttactagaaattggttgaaggatactagcaaagcctctagactgcttttgcaatttcgagttcaaatttatttaagttgaaggtggttttataaactgatcatctctataatcttagttaagcaagtccaaatatgttgttaatatatttaacatattcagtttcttttctacttaagtttgcttaatgtacaattaagctcagagccaaagaaaggaaaagagctaatcataatatggggtggttgttctggagtattttctgacacaaataaattctctaattctcccacaccaattgggtgttctacaattcaattctgaacaactgggtgttctataattcaattctgacactaacttctccaagttagtgcagactccacaagttagtgcagtccaagttagtgcagtgcaagttagttagtgcagtctaaattagtgcagactccacaagttaaggggctcagtccaagacttcccccacatcagatgccactcacaaggacaacctgcagttctgaatggtgataaattccgagttcccactgccctactcaggtttgataatttgctacagggctcacaaaactcaagaaaacagcgtactttgttttactggttataaaggacgcaaatgaacactcaaatgaagaggtacatagagtaaagcctaaaaagggttctcctaatctcaggagcctctacccctatgaagttgggggtgcaccaccctcttgggctatttggagttctcttaatctcattgtctaatctaatctccagcacccctccccttccaggaggtgggagaaatggggcacaaagtctccatcctctagttacttgatcttcctagagaacagccccattctgaggctgtctaggggagcaaccataagtcacttcagtagtataatcaggtgtaattaaaagggcagtgctatgaataacaacaacagcaaaaacaaaacaaaaccaaaaaactcttatcactcatgaaattctaagcgttttaggagctctatgccaggaaccaggaacaaagaccaaatgtatttctcattataccacaattttacacaacagtaaaaataaacagtaatgagacagtatattatggaatcattggcaaggcaactagaaatgaggattaaggtatcctgactgaaaatgcacaccaggtgtattagctgatgtttaaggttatacttattaagaaaaagcactcaaatattcatcattttcaccacatttcatgccttcatgagctgttgatagtttgctaaaggtgttccacatttatttgatagcatgttcggaacaattttactttctatgtgatctcctgacaaatgatgaagcagagtgcgtcgctgaaatcctgccatcaatactgtcaccttaaagttattttccagtgtaaactttgacactcactgaggtcatatttctgagtaaagactttgtcatggtcatcatgtttctatcaacaataagctcacttacgttgaaatctatgatgaaacctgataataaagtctatctttccacagaagacttttcttagtctttgtattcacagaatttatctctgtatacttttcagacatatgagcagaaattattgctcaaaacatctccacattaatatagtttattcaacgtattttcattgacagaaaatatgaggtaaaagaccactaaaggcactaccttatttactgtattcatcaaattgatctctagggcaaattatttcacctcctgaggacagacacacatctgtcaacaggcagcaccatgtttatgttccaattggctagaaacacactgatgtttaatgaagtctgagttgccacaaaaggcatttccatagtcacggcactagtagggttttcttctgcatgagttcacttataaggaaggagctgtgactctccattacaggagttttcaacttgactgattctacccatttctcttgtgtgcattttcttatgtttgacaaggtttgataagtgggagaaggctttctcacaatcactgcatccatacggcctctctcctgtatgcgttctttgatgtacattgagtactgactttgtggtgaaggcttttccacattcattgcactcataaggtttctctcctgtgtgaattctctgatgggtaatgaggccatatttgtgtgaataggattttccgcactcggtacatacaaagggagtctttcctgtatgacatctctcatgttgtatgaggcatattttctggctgaaggctttaccacattcattgcattcatagggtttttctcctgtatgagttcgctgatgtataataagagtgcgctttgtggtgaagcctttaccacattcattgcatatgtaagatttctctcctgtatgagttcgctgatgtataacgagagtgcgtttgacagtgaagccttttccacattcgctgcatatgtaagatttttctcctgtgtgggagcgctgatgtacaatgagattgctcttcacggtaaagccttttccacattcactgcacatatagggtttctctccagtatgagttcgctgatgtacaacaagatagcgcttcatggtgaagccttttccacattcactgcatatatagggtttctcccctgtatgagttcgctgatgtacaatgagattgctcttcacagtgaaaccttttccacattctttgcacacataaggtttctctccactatgagttcgctgatgagcaattagatagcgcttcattgtaaagccctttccacactcactgcacatataggatttctcttctgtatgggtttgttgatgtgtaatgagactactcttcacagtagagccttttctatattcattgggtatacagattttgtctgttgtattagttttcagatgcttagtgaacaggacacttctggataatttctcacattgaccacttccaggattctcttgtatacaaatgttctcatggtaaatgagctgagacttcctaaggaaggtttgctcacattcaatgcatgcatggggtttctcaattttctgagtcctctgatgcttgaagacttggaatttagtatggatacattttgcattttcagaaaatctagttttagtatgcgtacgttcatgcttaccatgtagaagtgttttctcacctccaataaactcaacagggttatttattccatgtcttctcttctggttgattaaacttaaacttgatttcaaattttttctgtacaagtcaaatgtatcatgattttgcactataggaaaatgtgtcttgctgagatgtacaatatttctaagtgtattctgtccattgcattgctgcacgctcttcagaagtctttggtttggagagtgctcttgcagatgactgtcaactttcccgattcctaagaaagaacagagtaacaaattcttccatgagaattgtatgagataaaaatgcttatgaggccgggcacggtggctcatgcctgcaatcccagcacttggggaggctgaggcgggcagatcacgaggtcaggagttcaagaccagcctgaccaatgtggtgaaaccccgtctctactaaaattacaaaattagccgggcgtggtggcacatgcctgtaatcccagctattcaggaggctgaggcaggagaatcacttgatcccaggaggacgaggttgcagcaagccgagattgggccattgcactccagcctgggtgatagagcgagactcagtctaaaaaaaaaaaaaaaaaatcttagcttatgagatgatttgctgggggctggctctttattgtcaactctacgatcccagtataaaaggaaattatgaagatataagctgaaatatatccaagaaatcagatccaagaaaagacaaaaagtctttaaagctataacagcattaaaaaagttatcagatggggagatgaatatatagtggagctgcttaggtaccctcagatacttcatatatgtgacacctttccttaatgactacaataagactcctatagccactgtccttgctggttctcacttacctggacaatttttattctgaattttagcatctgttgtccatggttcttgtccatgtgccaacttggagagtacatctggtttgctagtttgataccctgttcatgaggaaagacaaacacaaacatcctgaattggagtccagtatgtcaagatggaaaaataatacattcgatgaagaaaacaatttcaaagtaagcattctgtcttagaagagattataccactttggggtcagagaggggactgaaaatgtaactcttccaaacaccacagtgactgtaaagctttgattaggtgagcataggacggtgtctgggcattgtaggcacctctaggtgacacagggaaactattcttacccagtgatactaggtggttatagttctccaccatcacatcccggtacaggttcttctgagcagtgtccaggagctgccactcctcccagctgaattccacagccacatcctccagggtcagtgattcctgtaattacaaagtcctattcaatatgatataaactcctattgttaatatagaagtataagataattttttaaaaattttcacaatacagcctgcatctatattcctttctcaaatatactttggtaggagcaaaatcctctatctatacattttagcgcctatttctaaatattaaacgtaggcaaatgacatcaggacaaataaaacatccctacattaccaatgacttcacaaccaatataaggatctgtcatgaatagacttcacatcttgaattcataaaatagtgcttttaaataaatgtaagagaaaagatgaaactatatctgtataaagcacaaaaggcccctaaagttgattagatttttatttattttttaatttttaaagagagatggtcttgctctgtagccccaaatggagtgcagtgtcacagtaatagctcaatgcaaccttgaactcctaagctcaagcgaccttcccacctcagcctctcaagtaactaggactacaggtggatgctactaccaatttttgtagtgacagggtcttgttatgttgaccaggctggtcttgaagtcctggcctcaagagatcctcctgcctcggccttccaaagtgctgggattacaggtgtgtgccactgcgcccagcaaaaaaaaacttctaacagaaaaacatatatacatatgtgtattaatggacagattaacagcatattagatacattgaagattattggtgaattggaatatataagtggaaatggcagaaaatgcagtacagagaaaaaagataaatcataacaaagaagttaataaatatgaaatacagagttgcaagacctagtgtatgcccacttatggtttctaaaagggaaaatagtgtaatagagaagcaatatctattaataaatatccaaaacctaaaatatttcagaactaaatacctcaaatctcaaattcagaaatcccaacaagttcagagcaggaagtcacaactggtgtgacacatcagactgaaactaccatacatcaaatgcaaagggaaaactatagaatcatcaagagacaaaagacagattacctacaaagaaataacaaaatatactgatggctgacatttcaataatagaatccagaaacgtatggaatacaatcttcaaagtcctaattcttgcaacaaaaaaggccaattttggaaggccatttgggattaaaacacatggctagcagatgacttgctgtcttacaaccatgatatcaaggacctgtttgtcaactaaactgtcattctcctgcttcacaataacttttcagagaactgcagagtgtgaagtagaggtaactaagatccaaggaaatactgataagagaatctatgctatattactgtgtgggatgctgcatagtcaagaaagtagactcatgagagtgcgcaagtgctcaagcctggtcagtttatctcattccaaaatctttatgtgagatgtctatcgactgggtaagtgtaaagttaaatttctacctcactccacagtccaaaagaatttattactggatggaaatcttgcaggccaactctaaggtgtcctctgataatctcattctctagctgcagtgacttctgacatcaactacctgggttaggccaaacttcccaggttaaaagcacaatcctccacaagactgccctcacttcagacacaagctgcaagcttaaggctacacagaccaccctcaactccagcgagctggctacaaatgtgtggagctaccatgactccctcaggtttaataacttgatagaacaactcagagaacccaagaaagtgctgtgtttacaattagcactttactattgcaaaatgacacaaatcagaatcagctaaaggaaaatatgcacagggtgaggtctgggaaggttccaaacacaaagctgctgactgtcctctcctcatggaatccttggtggcattacatcttcctgactacattgtgtaacaatattcaagagtacttgccagccagcgaggcgcacctaaactttgatgtccagagattttattgagacttcatgatgtaggcacagtttattgaagcattgcccatgtagctgagttcagtctccagttccctccccttcctgactggtattacatggctcaaagccacaactctctaatcacttagtgcgctttttggcatgggcagcccctatccagagtcatgtcattgccataaattatctagggatctactatgagtcaccactatacatatagatataaactatcaaatatgagtggcccaccatgaatgacagagacactcataacttgggtaattacaagggtttagaggttacctcccaggaacgaaaacaaaggctagccaaattctttattacactctaggtgttcctgcccctgtgcagtaccatcctcctgagtatgaagtggcctaaaagcttgtttctaaagaaaagaatacagcaaaagtgacaagatgccactttaagattacactctatatgacttccatcttgctagcagaatctgtcattttctagctttgattaaacaatttggcacataggggaggtgcatgtgacaaaaaactaaaagtgggctttgacaaacagacaggtagaaactgaggacctcaactaaactacctcatttctcattctggaaatgaatcctcccaacaaccacataagtgagcttagaactgcatctttccccatttcagccttcagatcagattccaacccagctaacaccttgacgacaacccccatgagagactgtgaatcaaagtagccaggtaagccatgcccttattcctgagccacagaaagtgtgagatttttttttttaagtgttgtttcaagtcactaccttttggagtaatttcttaggtattaatagacaatgaatataagatgtaaacttaagaagaacttatgaggccaggagtggggcacacatctgtaattacagtacttccagaggagagtttgagcccaggagtttgagaccaacctgagcaacatagtgagactctgtctctattctctacaaagaacaaaaaattagctgggtgtggtagtggatgcctgtggtctcagctattcaggaggctaaggcaggcagatggtggttgaggctgcagtgagccataattgtgctactgcactccatcctggggaagagggcgagtccctgtctcaaataaagaaaaaaaaaaaaggaataaatgaaaacatgttcatgatataagtaaaaagctttaaaaaaaatgacttctgcatgggaaaaaatattttgaacaagctaaaagagaagtaagactctagaaaaatatttgcaacatataaaagaatcaatatccagtcaagataaacaattataaatcagtaagaccacaaaaaaattaaatgaacaaagactaaagacactttatgacagaataaataatccaaagaaacaacaaagagatgagaaggatctgaacctcactggtgaatgggaaaatgcaaaataaggcaaaataatactggatcatctagatcatggaaaatacacaatttgataacatagtaagtgttggcaagatttgcagcactgaatgtttttgtgcagtgttttccaacactaacaaccaattctccaattatctaaacataaactagatgtccaacaattcaattcaattctgacactatctttgtcagaatccacagatttaagggttcaatcctacaagactgcctcctcttgagttcctctgcccggccgccccactgtctgggaagtgagaagcgcctctgcctagccgcccaccatctgggaagtgaggagcacctctgcccggccgccccacaccaccgccgccatctgggaagtgaggagtgcctctgcctggcccccgcaacgtctgggaagtgaggagcgcctttgcgcggctgctgtgcgaccctccaagtgtgaagtgacagccttgtgtgtgatctttctgccctccccaagtttgcattttcgacattaaagtttacttttcaattaaaatttttaaattggagaatatataatttaaaaaaaaaaaaaaaagactgcctcctcttaagatgccagtcacaagtcctgggctaccagtatttctgactaactggctataaattagaggctcccacaaacccctcctcaggtttgataatttactagaacagctcatagaactcaggaaacactttacctatggtacctagttaataatagaggatataactgaggaacagccagactgaagaaatgcatagggcaagatatggaagagggtgtgccaagcttccattcctctctgcgtgtggcatcctcccagcaccctggtatgttcacaaacctgaagcttgttcaagagtacaaaaaattagccgggtgtggtggtgggtgcctgtagtcccagctactcaggaggctgaggcaggagaatggcatgaatccggaggcggagcttgcagtgagccaagatcatgccagtgcccgccagcctgggcatcagagtgagacgccatctcaaaaaaaaaaaaagaaaaaaaaaaaaagaaaaaaactcacagcctgggcgacagagcgagactctgtctcaaaacaataataataataaataaaatttttttttttttgagatggagtatcgctctgtcacccaggctggagtgcagtggcacgatctcagttcactgcaacctccacctcccgggttcaagggattctcctgcctcagcctcctgagtagctgggactataggcacgtgccaccacgcccagctaatttttgtatttttagtagagacgggctttcaccatgtaggccaggatggtctcgatctcttgacctcatgatccgctcgggattacaggcgcgagcccccatgcccagcctgttcaagagtttttatagaacttactctccagtccattcctcctttcagttccaatcctctaattgcttggtctttctggggaccagtctcatcctgacactatctagaggtctcatgagtagtcacctcatgagcagaaattcaggtgtatcacagggtttccttatgaataacaaaagacacacctatttctcaggaagaaattccaagggttttaagcatactgtgccatgaactgggaacaatgaccaaatatacttatccgtgtcactttctatataccagactgtgaaaaataaatatacatttggtctctgccctccaaatctttggaattgctgaagtgtcttttatatgctattgagatgactggtgcctggggctcttccatggcctcaggaagggagctggttgccaggggaaccaaccttgtgacagacagttggaactttcagtctcacctctccaaccaacccctgacctctgtggaagggagaggtgatggaaattgagcttaccaccaatagttaatgaattaataaattatgcctatgtaatgaacccaccaaaacaataaaaggatgaggttgagagcttccaggctgctgaacatagggtagtcctgggagggtagaatacccagaaagggcatggaagccctgaggcccttccccattacctgacctatgcatcttttccaactggccattcctgagttgtaccctttcataataagccagtaatctagtaagtaaactgtcttcctgcattttttgagccttctagcagatgaatagatctgagaagggggttgtggggacatccaattggtagccaagtccaaaagaacttgtgagtaacctggggacccagcacttttcaggggggcagtattgtgggactgagccctcaacctgtggagtctgtcctaagtctagacaattagtgtcagaattgagtaaattttagaatacctaataggtatggagaattgaattgatgtgtgggaaaaaccccacatatctggtgtcagatgtggggaaaagaaagagagatcagactgttactgtgtctatgtagaaagaagtagacgtaagagacttcattttgttctgtactaagagaaattcttctgccttgagatgctgttaatctgtaaccgtagccctaaccctgtgctcgcagaaatatgtgctgtgttgactcaaggtttaatggatttagggctatgcagaatgtcctttgttaaaaaagcacttgaaggcagtatgcttgttaaaagtcatcaccattctctaatctcaagtacccagggacacaacacactgcagaaggccacaggggcctctgcctaggaaagccaggtattgtccaaggtttcttcccaagtgatagcctgagatatggcctcgtgggaagggaaagacctgaccgtcccccagcatgacaccgggggatacccgtaaagggtctgtgctgaggaggattagaaaaagaggaaggcctttttgcagttgagataagaggaaggcatctgtctcctgccaactacttgggaggctgaggcaagagaatggcgtgaacctgggaggcagagcttgcagtgagccaagactgcgccactgcactccagcctgggcaacagagcaagactctgtctcaaaataaataaataaataaattagtaattttaaaaaagttggttggcaggcaccagcatgcaaagaatgccaatattccaaaaatggtctggagtatgtacattaaaatgacaaccatagttccttcttgagtggtgggtgattcatgtatcattgtaatggtcaaaagttgaactaccaacaaagcatggattctttcatattgagtctacttttttttccttctttttgagacagggtcttactttgtcacccaggttggagtgcggtggtgcaaacatggctcactgtagcctcgtcctcctgagctctagcaattcttctcccaccttagcctcccgagtagctgggattacaggtgtgcaccaccacacccagctaatttttgtattttttgtagagacggggtttcaccatgttgcccaggctggtcttgaactcctgagctcaagcgatccagaatctacttcttaaggcagaatgaacccccacctctactcccaaaagcaatgtaagttaatttctccctagaacacaattatcccagtatatacttccttaagttcaactgacttcttcaggccaccataaatctatcaaaaaatcaaagggaaaatatcacctgggtcttgatcattttcttctgtgctcagaaaatagtggataacatggactatacgtctttgtctcttctgcatttgccatgaagtttttgaagttttcctagtcagaaatattagtgtccacttaaagttgtccccagaaattatgatatccaaggccagcaacctccttcttcttccttcattgcttcacttgagttattttgcttctgggagccaggacctgaggactgataaacaaaatggctttcagtgtacattaaccctgggtccagacattgtcactgctgctctgcacttaccttaaataaaagaccctaatatttctaacagttcctttatttgctgcctcagaggttttcatggttctaaatgtgtgaaatctatgcctttcttttgtgaagtagaagtggcatgactattatagagaaggtgggaaagcagaaccagcacagcacaatgcctcagaggcaggtgtctggggaaaagaaagagagatcagactgttactgtgtctatgcagaaagaagtagacataagaggctccattttgttctgtactaagagaaattcttctgccttgagatgctgttaatctgtaaccctagctccaaccctatgctagcagagacatgtgctgtgttgactcaaggtttaatggatttagggctgtgcaggatgtgctttgttaaaaacgtgcttgaaggcagtatgcttggtaaaagtcatcaccattctctaatctcaactacccagagacacaatacactgcggaaggccgcggggacctctgcctaggaaaaccaggtattgtccaaggtttctccccatatgatagcctgagatatggcctcgtgggaagggaaagacctgaccgtcccctaccccgacacctgtaaagggtctctgctgaggaggatcagtaaaagaggaaggcctctttgcggttgagataagagaaaggcatctgtctcctcctcgtccctgggaatggaatgtctccgtgtaaaaccccattgtctgttctatttactgagataggagaaaaccgccttagggctggaggtgagacatgctggtggcaatactgctctttattgtaccgaaatgtttgtgtgcgtgcacatcaaggcacagcacgtttccttaaacttatttatgacacagagacctttgttcacatgttttcctgctgaccctctccccactattaccttattgtcctgccacatccccctctccgaggtggtagagatagtgatcaataaatactgagggaactcagagaccagtgccagcgtgggtcctccgtatgctgagtgctggtctcctgggcccacttttctttctctatactttgtctcttatttcttttctcagtctctcatcccacctgacaagaaacacccacaggttgtggaggggtggcccccttcaaggtgaattctcagacagatcaattttaggaaagagaacacatggaaggctccaagaatgtctttaaaaaccacgtgtgcccatgtactggttcgaaagtctctgtaagctctttgggtatacatacctcgtgtcaagaccaatgtactaagcaaatcacaagaactgtctcatttcacattatgcgctaaaggagtaactttacccaagagagctttgtcctttgcccacagttcctatgaggcaaactctaagcctttggaatacgctgcttgataaaactgtctttggttatcagggcaatttaagccatgccaaattgtctatcctaataatgtgatttactgtgggagaccttggaccacgtggtattagtttgatatctggaggagctggagattgaagtcagcctcataggcagtcaattgtgtgtgtgtgtgttaactgatatccaataaaactctggacaccaaggcctaggtgagtggcaacaatggttacaatggctggcaataataatataagggtgtatatataagaatatgataatttaaaaacgtatgaagcaaaacagaatgagagaggattagacaattcaacaataataattgaagactacattaccctacttgcaataataaagaaaacaaatagaaactcagcaaggataccgaaaacttgaacaacattatcaaccaactagacttaacgaacatttaacactgcactcaacagcagtaaaataaacatttttttcaagagcacatgttatattcttcaggaaagataatatcccatgtgatagcctgagatagggcctcatgggaagggaaagacctgaccgtcccccagcccaacacccgtaaagggtgactcacaagggccccagacccagacagagtcggactcgtcgctgatttcctcagactcttcatccctacagccaaaggacccgtcattaacgccccgcttcctcagcgactgcgttcaaatacagccccaatcaggacgctccacgcaccatcggtacacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttcagactgcgggcgccgctctatgaggtcacagggctgcgcccatcgcagcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgcccattatagctgagagtggagccttagctggagcaccatgggcacggccatcttagaggaaggcagcagccgtacggcagagaagatgctcatatccaggacaatttggaaaaataaacaaggtttgaagaagtcacggtgctggccaggaagcggtcacagagttgccaaaaccagtggtcactgaaagtgttagatttggggatagggcgggggttctgggctgggtaaggcttttgtgggttagattagactctgactgaatggacgaagccgagaacaggagtgatgctccattaaatgctaatacccacatggggcttgctattaaaaccactgccagtggggaaggggatgaggaggtgaaggtgcaactgtgttaatatctacatgtttccttccagaagtaaaggaagatgacagtggggcacttaagaatatgaaattattagaatgcgatcatcctactttgcaatgtttccagattttttaaaaagtcacacttaaaaaatattagttctatttttgcagatgttggcgttgtaactgtagaagatttaagtaaatattgtatttttggaaggcaacctagagccaatttaattttttcgttttctttgacacagcaattctaaaagctatctaggcaaatctgtcttaatattaaccacaacttttgtaatttacaaaaaaagggaattacaatgagagatgaatactttggtaaattatggaacatctgctgaactgtaagagtatatatcaatttaaaagaatatgctacaattgttttataaaaaagaaaactttgtcagaggacaaaaaaatgatctgcaggatagtatatattttatggtcttgttattggaagaaatcataaacatcttttggaaaattgtgattggttaaacaagacatttagtttgaattaatattgtttgtgttcataggtagagaatgccatgtttttacttgaaaaatattcccaatttatacttaattttactatctttgtaccataatcatgaatatattataaaacatgttgatcttagaaaataggtatgatgatgtataataagttcatggcatgataaatgcaaaataggctgttttctttcagaaaataaatatgctcatgcatttgaaaaattctggagaatatactaacaatatttgactgttccgtacaattatggtgacttaaaatttcttcattttacttacgttttgtaatttctagagaataagaatttcatgttcgtatttcttgagtgttataacatattccatccaggattaaatttcagccccgttcatctggaatgttaatctctggtaggtaagtttagcacctggtccacaggactatgagcagcccatgatgggaccttcactgatcatttccaggagtgggctgataaaactttgccgtggcaggctgtgctgattcacgggacaaggaaggtgattcaagggcctggttggtggagcacttttgtctgattcattgctggagacaatctgccctgaatccatcctgttacagtgtgggaatggtgatgggagcaccaatccacaatttagggcagagatgttcaaatttaagaaggctctttttataaatgcagagtccgaaccccatccccagaaattctagcttggaatgtctggggagtgactcaagaatttgccttcttttacaagcttctcagagaatgctgaggcaggaaccccaaagaaaacacttagaaagttctatagtgttctggacttaaaaatatgatggctgtgtccccacagtatatttaggctttggttcaaattatatctgcacagaaaagcctatcctgaaaactcttcctaaaataactcaggttacaatctatgaacttaccaggctttatatttcttcctagcacttaactgaattcgattttgtatttatcttactcagtctccttcaccagactgtatgtcatatcaaagccagcactttgcctgttttgttcattgatgtgtctccattgcctacaacatgcctgccatggtgtagaagctcaaaaaatattttcaaagaagtaaattactcaatatggagtcagggattgaattctgccacaatactatatggcaaatgtctattacttttataaagagaactcaccatttataaactggattaaatctcattagatcaagggaaataactctggatagagaaaacaggaaccctgtttctagggaaactaataattttttgccaccaggcctgctcaaagagaaatgattaaggaagttcgcacaaaaaggaaataactaaaggaaatattacatcaggaatgaagaaaaaggaacagaaagggtaaatatattataaaatataatattcttttgagttttaaacattgggtttgctggttggaagcaaaagttacaattttacttgatatggttctcagtggatgtagagatgcttaatatcattttgtgttaggggtgtgtaagttgaggccatgatcatataccaccacacacctaataggaaagctaaagcacactggcaatgccaagagctagaaagggcatggaatgcttacacattggtggtgggaatgtaaactagtacagccactctgggaaagagtttggccatttcttataaagttaaacacatttaccatattcgccagcagtcatgcccccagtgtctatcccaaatatataaaaacttaacgttcgcacaatatcgggtacacaaatagtcacagcatctttatttataacagcaaaacactggaaacaacccaaatgtccatcaacagtgaatggatacacaaaccctggtgcatccatttaaaagaatactaactcagtaacaaaaattaaaactatttagacacctaacaacttggatagatcttaagggtaatttgctgagtgaacaaagccctatctcaaagcttgcgtaccttacgattccattttaatagcattcttgaaataacaaaattagggtaatgggatcagtggctaccatgggtcatattgggaggacagtgtgagtataaagaggtagcaagaggaggccaggcgtggtggctcatgcctgtaatcccagcactttgggaggctgaggcgggtggaccgcccggggtcgagagttcaaggccagcctggccaacacagtgaaaccccgtctctactaaaaatacaaaaattagtcgagcgtggtcgtgggtgcctgtaatcccagctacttaggaggctgaggcaggaaaatctcttgaacctgggaggcggggttgcagtgagccaagatcgtgctattacactccaacctgggcaacaagagcagaactccgtggtttttattattatggttatgtaagataacattgatgatgctaagcaaagaatactcaggaaacttttgtatattttgtaatctcttgtgaatctagaattatttcaaaacaaattttagaaaaataacatttaaggcatttttgtaaactacataatggtacctagtaacttggataaacacatccaaatatactgaattacatttatcagtaaattgaaaaaaataaatttggggcctataatatgtaagaactaataaataacaccagattggcacagaaaacacctgtgttatatataggattaaaatttaatcagtgataagaacagcccgctttacaattatggaatcattgataatatgatgcaaggtatgctgtcacagaatagatatcaagtgtatcatgagtttagatttgtgacagtcctcaaatatggttttttttttttttttttgaggcagagtttcgctcttgttgcccaggctggaatgcaatggcgcaatcttggctcactgaaacctctgcctcccaggttcaagtgattctccagcttagcctccagagtagctgggattacaagcgtgagccaccatgctcggctaattttgtatttttagtagagaggggggcttcaccatgttggtcaggctggtctcgaactcccgacctcaagtgatccacccaccttggcctcccaaagtgctgggattacaggtgcaagccaccatgcccggcattatgtatcattttcatgagacttttttacttcatgaatttcctgatcctttttaaagttactcttcatataagttttatttctgtatgaagtaatgatgatgaggcagcatgtatcactgaaatcctcgtgtattcactgccatctgaaacttgttctccagtatgaaatatatctgccaactgttaaggttttatttctgggcaaaggctttcccatgataatgctgctagtatgtgtaagttcattgatgatctattatgatcactgaagagatagggtctttcttcccatagaaggctttcctagcctactcctttgtaagatttatctcagtaaatacttttcaagacatagttacttagaaaattttcaagacttttctgcattggatgtatcaagtttatttcctacatgtttattgtgacataaaatatgaggtaattaatcaccgaaggcactagtgcattctctgcattcattaaaattcgctcctggaaattgcattgtcttccaagggtgaaaatctagcaacaggctgctctacactgcctatatgcatgtatgctaggagcacactgctgtttaatcagttcacattactaacgtggttttctctctgcatgaatttgtttgtatgtaatcagttcagattctctgcaaaaggactatgtaccttacacatttgtcatgtggacgttgtcatagttttaatgaaggttgacaaatgaaaggttacccccaatccacagactctctctcagatgagtaattttctatacattggtacatcaaagaattcagagcctgaattcatgttgaagcctttctgacattgatagcattcatcctagtgaataacactggattttgaaatatgatttttcatactcagtacacatgtagaaaatctatactgtgaaatctctgatgttgtacaaggcagattttcttcccaaaggcatgaacatgtccactgcattgtcagggtttgtttccattatgagttcgctgatgtacaatgagatttctctttgaggagaaggcttttctacattcactgcatacaaagggtttctctcctgtatgagttcgttgatgaacaattagacggctcttcatagtgaagcctttaccacattcattacatccataaggtttttctccagtatgaacttgcttatgtaaagcaagctctgtttccttggcaaagcctcttccacattcactacatatacaagatttctcttctgtatgaatttgctgatgtacaatgagatagcgtttcatggtgaagccttttccacattcactgcacataaagggtttctctccagtatgagttcgctggtgtacaacaagattgctcttaaaggcaaaaccttttccacattcattgcatatgtacggtttctctccagtatgagttcgctgatgtaacatcagtccgctattcacaatgaaacctttcccacattcactgcacctgtaaggtttctctccagtatgagttcgctgatgtacaatcagccgactcttcaaggggaagcctttcccacattcactgcatgtgtagggcttctctcctgtatgagttcgctgatgtatgatgagcatgcttttcacagtaaaaccttttccacattcactacatagatatgacttctctactgtatgatttctctgatgtacaataagattactcttcctgggaaagccttttccacattcactgcatatgtagggtttctctcctgtatgagttcgttgatgttcgatcatacggctcttcatggtgaagcctttcccacattcattgcatatatatggtttctctcctgtatgatttcgttgatgtatgatgacatagtgttttgtggtgaagcctttcccacattcactacagatgtagggcttctctcctgtatgagttcgctgatgtataataagcatgctcttcccagtgaagccttttccacattcactacatatataggatttctctccagtatgatttcgctgatgtacaatgagattacgcttgcctgggaagccttttccacattcattgcatatgtagggtttctctccagtatgagttcgctgatgttcaatcagacggctcttcatagtgaagacttttccacattcactgcatataaaagatttctctcttttatgaattctttgatgttcatttagcctggactttctggagaacacttttgcacacaaagtacatccataaggtttttctcctgtatgaactctctcatgatcagtgagctgagacttcttgacaaacgctttcccacattcactgcatacgtggtttttttctatttcatgagttctctgatgcttactgacttgggatttagtgctattggcttttgtacttacagagaatttagctgcagaataaagttcttcatagttaccatgaagaaatgatttcccatctccactaaatttagtagagttgttaatttcacagcttttgttctggttgactaaacttaaatttgatttcaaagtttttatatataactcaaatgtatcatgattttccctgaaaagacaaaggcttttggtttgagaggcagtatttccaaatgcattatgttcatggtattgttccacactcttcagcatcctttgattttccaagtgatcctgcagatgatcatcaacttcgttgttttctaggaaagaagagaacaatgaatccttttataatcttgttggggataaaactgtcttcttagaaaaaaaaatccttggtgttttattttgtttattattattattttttgagacagagtctcgctctgttacccaggctggagtgcagtggtatgatctcagctcactgcaacctccgcctcctgggttcaaccaattctcctgcctcagcctcccaagtagctgggattacaggcatgtgccatcatgcctagctaatttttgtatttttagtagagacagggtttcaatatgttggccaggctggtcttgaactcctgacctccagtgatacccctacgtcggcctctcaaaatgctgggattacaggcatgagctaccacacctggccaggtgtttttaaatatcgctatttaatgacaatactacaataatagtataaaagcaacttcatgtatacactttggtaaaaacataataatataaacaaaccaaaaagtaaaagcagtctgtgtgcaaataaggtgaggcagttgacaatctatatcgatttgacagctttctaaacaggaccttgcaaaacatgcggacacagtaaaatacaagcaagtcattattacaagcaaacaacagggcttggaggaacaccattccacaaaattttgggagacaccagaccacaaaggtggaaaaggcaactgattcacaattctgagggttgtatttattcactccactagttatttgtcaaatgactcctatggacaaggcactctgctggcatttgggatacacaaaatatgccttcttttcactcatgctgaattctaattaggaaaaacaatacgaaggaacaaaaaaagaagggagttggtgatgttaagtgtggtttgatggagcagtgtagatgatgagagttggagaaaagcaggatatttttgtataacgaaaagacaaggttaaatgatgaattcaatggggagagtgaggaaagtgagggctcaaagattactaactatatggcttgagccactgggtagatgacagcatctgataatgagatggcaaatattactgcagtccagcacatgtaaagtatatactgtgaaacacactttgaaatggttatcaaatatgtaacacagacatcaagaatctggttggaggtataaatggagaaggcagcatggaaataatcagtacatacatattatttgagaaaaaaggactgaatgacttttttttttttgagacagggtctcactgtcacccaggctggcatgcagtggcacaatcttgcatcactgcaacctccacctcccaggctcaagcaattctcccacctcagcctcctgagtagccgggactacaggcacatgcaaccatgcctgattgatttttgtattgtttgtagagatggagtcttgccatattgcccaagctggtcttgaactcttgggctcaagtgatctgcccacctctgcttcccaaagtgctgggactataggtgtgagccaaggcactgagccaggataccatgttgagaagacatgtagaatgaaagatgaaggtacagaaccaaggttgtagacattccaacatgtggttttgggattatttaagccctgttagaggaaccaaactgtgaatacaaagatcagggtaatatgcttactgagatatatagaataaatacattcacgtacatgttgcctggcaagtaagaattggaaatctccatctgttgaaattaagtcaactgagatagactcttgtgtggtaattgttactaaatttgcccctcttcaatctgtagactaccatctaactttccaaaaacatccatcacgtttaatgaacaactcctatagtcaacactccaccctttggtttagctgtgttgcgttatcatatgtttcattaattatgaaacaggaaaacaatgatagggaattttgcaactggccagtgtaccatgtagttgccttcagaagaaaatgtgctgctgcatgggatatgaaaactgtcattttcttcaatcacattctgcatgcagtagaaaagtcgtatcaaggccaggcacggtggctcacacctgtaatcccagcactttaggaggtcaaggtgggcagatcacttgagctctggagttccagaccagcctgggcaacatggtgaaacacaaaatacaaaaattagccaggcatgcatggtgatatgcgcctgtagtttcagctacttgggatgttgaggtgggaggatcgcttgagcccaggaggttgaggctgcagtgagccaaaatcgtgccactgcactccagcctgagcaacaaagtgagactctaccttaaaaaaaaaaaaaaaaaaaggtcatatccaatttttcccatttcaatgtccctgatacactgtttcctcatctgccaccaataacatctacttcagtaagctacatttatgtctcagcatcagttaagttgtactaaaggataaacttcttctagacaaaggttgtggcatcttcaccttcagtttttcttaagatatttagctgtttcttattattgctacactgctgtcatccaagtgaaaggtcaagactagcaacatattttatgaaaagacaaaaatataaaattaaccaaccctcaaccatgctacctcaattactcatatatacaatcaaaagtcatcttgataaaaaaaagtttacattaccatgaatattaccatgtttctgctccacgatttctccaacaagcagcttctatcactgacctgtatttggccaacttgaagccaatcttttgatagtcaggcccatggccttgcacaattcctatttcatgccttcattcttttttttgagatggagttgtgctcttgttgcccaggctggagtgcaatggcacaatcttggctcaccacaacctctgcctcctgggttcaagcaattctcctgcctcagccttcctgagtagctgggattacaggcatgtgccaccatgcccggctaattttgtatttttagtagagaaggggattctccatgttggtgaggctggtctcaaactcccgacctcaggtgttccccccacctaggcctcccaaagtgctgggattacaggcatgagccaccgcacctgacccatgccttcattcttaattcatgtcaccatcttcctaattcaaaatctagatatgccttgtgcacatcatactcttgctgcaattctgactatcctgccatatgctctatgttctctgtattccttaattaacccctttattgttaatttttatggtaatcttctgtgtagtgaggatctagctctaacctcatccaaacagagatctagcatttgttcttagctattaggaaatgatctctaggcccctggaatgtcctggcccataggagtgtctttgtttgcctggtggctttagccactggacagtttaacaatatgatttgtgataggggctttggcccatgccatatcacttccagcctttggaaaaactggacactctaggtattagcctgacttccaggagaggctgaagactaaaagtcagccatgtgggctgtatgtgactgaaacctaatcaaaactctggccaccaaaggctcaagtgaacttccctagttgtcaatactctgtactgtcacacactgtgtggctgggaagagatgtaacatccacagtgagaggaggaccagagaagtactgtacttggaccccctcctggactacaaatgacctggcaattctactcctaggtgaaggctcaagaaaaatgaaaacatacgttcctaaaaaagttgtacatgaacgttcatagcagcatgattcataaaagccaaaaagtagaaataacccaaatgtcaatgcaatagatgaattgataaataaaatgtggtatatccatacaatggaatattattcaacaataaaaagaaattaagcactgatacatgctaaagaatggaagaatttcaaaaacattatgctaaatgaaagaagccggacacaaaagaccatatatttcatgattctatttatataaaatgtccagaacaggcaaatctatagggataaaaagtagaggccaggcacggtggctcacacctgtaatcccagcactttgggaggccgaggcaggtgggtcacgaggtcaggagtacgagaccaaactggccaacatggtgaaaccctgtctctacaaaaacacaaattagctgggcatgatggtgcgcgcctgtaatcccagctacttgggagcctgaggcaggagaatcgcttgaacccgggaggtggaggttgcagtgagccgagatcacaccattgcactccagcctgggtgacagagtgagactccatctcaaaaaaaaaaaaaaaaaagaaaagaaaagaaaaagaaagtagattagtgattgcctagggctgggggcttggaaacaatttttttttttaagtgatactttgaaaatcttccaaaattgactatggtgatggttacataactgttcatacactacaaagcactgaaaaataaactttaaattggaaaattgtatggtatgtaaattatctaagctgttgaaaaaacaaatctataatgggaaaaacacattagggaaatgaatacaatgctaccgtctaagatgaactaaaggaaaagtagaaatcaaatgtacaaaggaagtactctgagacagacataagttatgacctggtttggtctagaactgatgtaggacataaaacagtcctttctaggtaaacagtaaacaaaaatagtagagacttttaagaagagaactccataggtagaggacattcaatacaacaccagcacagacaggacagatgtatggtactaaaggagaatgcaaccttaaaataagatgggaagggtttcttgtggagggaaaacgattcccattcctaatgtaggcactgcttctgtgtcctcagacacccacagagccttctttcactgactataatattacttacgcatcttgctgcttctcacatacctggacagattcgactgtgcctttcatcttccattgtccatggttcttctcctcgttccaacttggagagtgcatctggtttgctgacttgataacctgtttacgggaaataatagaagacagacacactggattgggctggggtatgtaatgtgagagaatgttacatttaagtaactagacagttttcacatctgaaagtagaggcttctctctcaggaaagggcagattacagtcagaccttaatatctgaaaatttcacatccagggattcaaccaaccatggattgaaaatattttttaaaaaacaataaaaaatacaataataaaaaaaaatacaaagtgcagtggctcttgcctataatccgagcactatgggaggctgacatgaaaccaacatttgaagccaggagtgggagaccagcctgggcaacatagactccatctctacaaaaaaaaaaaaaaattagccaagcatggtggtttgcacctgtaggcatagttcctcaggaggctgaggcaggaggaacacttgaacccagttcaaggctgcagcgagccatgaaggcaccactacattccagcctgagtgaaagaccgagacactgtctctaaagaaaaaataaataaataaattaattaaaacatatagtataacaactatgtacatagcatttacattgtattaagtatcaggcataatttggagatgatttaaagtattcaggaggaggtgtgtgtaggttatatgcaaatacaatgccattttatatgagacttgagcatctgtggatttcatatccatggaaagttgtgaaaccaatccctcttggacactgaggggtgacggtatatccttttatcagaagccagaggatgtgccaaaaatctaatattcagagcactgcagtaacttccaagggtaagcaactgagaaagcaaaggccacagactgggcaccctccaggtgacacagagcagctgtcctcacccattgatagcaggttgctgtagatctccaacatcacatcccggtacaaatccttctgaaaagggcccaggagctgccactcctcccaggtgaactccacagtaacatcctccagtgtcagcaattcctgtaagaaaacagagccttgcttaataggaagtgtttctcttttactgacatgaaaagaaagtgaagggaagttgtcccgctcacattaaacatatagactgcatccatctataagtctattgtattttttaatattgccagagaatctccaagtattctataattgcacagtgccccatttgctcaacaaaaattaaggttttatatcaaatcctctcagtaaaagcgggttttatgtataaattttaattttggtatctattgaccagtcaagaaagtatatgctactgacatctagatatctgatataaattgtttcattcactgttaagccttcccagctaatactagcataagacatagagagacttcagatgctagaaccacaggatactacattcatgtttaattgttaaatggattaaaaaatagaaatgtacagaaaacatgagaaactattaaagagtaaccaaattgggaaaacttattcttggaaacatacattaaatatatatgtatgcacacatacatataaatatatgtttatgtatatatacgtatacagtcacaggtatatgtgtctattaacagaaaggttatattaaatacactgaagagataattagtgagttggaattcacagtaaaaaaaataacagggccaggtgtggtggctcacacctgtaatcccagcactttgggaggctgaggcaggcggatagcttgagctcaggagttcaagaccagcctgggaaacatggtgaaatcctatctctaccaaaaagacaaaaattaaccaggtgcggtggcacacacctgtgatcccagctacttgggagggtgaggtgggaggattgctggagcccaggaagttgaggctgcagtgagctgtgatcatgccactgtactccagcctgggtgacagagtgagaccctatctcaaaaaattaaaataactgaaaaatgaagcagagacacaaagtgacagaaagtatgaaggagactttactaaatatggaagacagagtgaggcctaacatatgcctatacatagtttttgaaatattatattcaaataagagaagcaatttccaaatatctgactgagaaattttcagaactgattaaatatcctataactcaaatttaataaatcaacaaagccaagcagaaaatctgcatctagacacatcagactgaaactattgaacatcagatgcacatataacattatgcaaacaactgttaatagaaggaaaagatgcattaccatcaaaagaaaaataaaatgtcctaacaactgacttccacagaaacaaaagaagcaagaaaagtgcagaataatgtcttcaatgtcctgattctgtggcaattggcaaattgtatggtatggcctagccctgaatgccactggaaaataaattgagaccctcttgtcaactaaactgccactctcctgtctcaacatgacttataatcacatggtagtaggaacttgaggcaggaaagagctaggtgcaaatttgtggggaaaagcaagagagatcagattgttactgtgtctgtacagaaagaagtagacataggagactccattttgttctgtactaagaaaaattcttctgccttgagattctgttaatctatgaccttacccccaaccccgtgctctcggaaacatgtgctgtgtcaaactcagggttaaatggattaagggcggtgcaagatgtgctttgttaaacagatgcttaaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtatgctccatctactgagataggggaaaaccgccttagggctggaggtgggacattcgggcagcaatactgctttgtaaagcactgagatgtttatgtgtatgcgtatctaaaagcacagcacttaatcctttaccttgtctatgatgcaaagacctttgttcacgtgtttgtctgctgaccctctccccactattgtcttgtgaccctgccacatccccctctcggagaaacacccatgaatgatcaataaatactaagggaactcagaggctggcgggatcctccatatgctgaacgctggttccccgggtccccttatttctttctctatactttgtctctgtgtctttttcttttccaagtctctcgttccaccttacgagaaacacccacaagtgtggaggggcaacccaccccttcacaaattgatgggataatctatccccatataatcacagagattaatacacagagaaaagaacagacttgctgaagtctgcaaattcttaatgctgctgatctcatcacattcgggaattatttcacacgagaaataaatctgtttgaaaaaaaatgtaggtttctacctaatttcatactcaaaaataagtttttcctgtttaaagtccttaccagaaagcaaaagaacctgtggaagcagaagcaaatacgaaatatattcatgttaaaagccataaaggaaaaaaaagggacaaattttatgagaaaaaaaatttaatttctacattgaaaaacagatcataaacaaagctgaaagaaaaatgacaggctaaaaaaaactttgcaataaacaaaagatcaatatatagtagatataagcaactcattagccagtaagaaaaaagtttttttaatgtaaaaatcataaagtcaggcatttcacaagagaaaaaaatccagttggccaagaaatacacaagaaggctttcaacctcacctgtgatgaggaaaatgcaaaataagacaaaagaatattggatcattgaaaattgtataatttgataatgtcatatttttaagtattggcaaagatttaaggcacaaaggactccatgtatcagtttctatgtggcaggcactcatctaaatactttacatagtttaacaatgttttcatgtatgactttagacaaatggaattttatacagtcaatattcttcaattaattgcagtgattattcctttatattctaaaactacaccacctaaggtaggggtgtccaatcttttggcttccctgggccacactggaagaagaaatgcgttgggccatgcataaaatacactaacactaacgatagctggaaaaaaatgcaaaaaattctcattataagaaaatttacaaatttgtgttgggccacattcaaagccatcctgagctgcatgcagcccacaggccacaggttgtacaagcttgatctaaggtgaccaacaggtggaatgtgattccactgaagcaaaagaagtcataataaatgtgtttatatatgcagacacatacataaaacacatggatttataaatacacatatatacagagatgcacacatttcagtgacagcaagtatgtgctaccaaacatttgttgaagcagtataagaggattaggaagaaagttatgaagagggaatctacttttactttttttaccttttttttttttttttttttcgagacggagtttcgctcttgttgcccaggctggagtgcaatggcatgatctcggctcaccacaacctccacctcccggattcaagcgattctcctgtctcagtctcctgagtagctgggattacaggcatgcgccaccacacccagttaattttgtgtttttagtagagatacggtttctccatgttggtcaggctggtcttgaactcccgacctcaggtgacccgcctggttggcctccaaaagtgctgggattacaggcgtgagccactgtgcccggcccggaaatttacttttttaaccagtgtgtacttcatcatcagaatttatttccctgtgaggccaggtgcagtggctcacgcctgtaatcccagcactttgggaggccgaggcgggtggatcacctgaggtcaggagttcgagaccagcctggccaagatggcaaaaccccatctctactaaaaatacaaaaactagccaggcatgcaagtgcacacctgtaatcccagctactcaggaagctgaggcagaagaatcccttgaacccaggacgtggaggttgcagtaagccaagatcacgcactgcactccggcttgggcaacagagtgagattccatctcaaaaaacaaaaaccaaaaaaaaaaaaaaaaaaagaattttttccctttggattccatgagtaatttatgtaattacaaaaaataaaagcaatataagtatgcaagaattggaggtgaaaatgcagaaggatattgtatattctgagatgaggtgaagttatcaaacatggcacccaacgactcaagaccttatcagacaactccctaatgccaaatctgcagttaatgccagttcagccacatgttcaggaaaatggaagctatgcacaccttccattttcctaggtcacttagattttattcctaaataagctcacacagacacgcaagacttgagtgtgtggccttgctttcgtcccctaaaaaaactgtttccactgagtttgcctggtctatttccataggagtctctgaggaaccgtgtaataaacagcagtaagaaatcttctgcctttattagaaagctagttcaaaacactgttcaccatatcacctctgggaagaatagcaaatttttcttgagatctaagtgccatgaaataataatctcctgaggaacctgtctgctttctccccacagtcactgtataacttagtgtgactttcttgtactggctgtcagagacatcagatgcaaactgagagctaaggtaatggaaaggatcttctagtcaggcattattttccaacatcagtcattttgtaggaatcacataaacactatattcctgatcttactttgccatgatgttggagttagatttaaagtttatttctctctagattctgaaatgatttcttacgggtctctacaaatccactatggaataaaggagagaataaaatagagaaaaagtcacctgggcattgatcattttcttctgttgtgggaaatggccagcacctgggatactctgtctttgtctcctctggatctgccttaaatttctatttagaaacttcagtcaccagtgaagggtgtccacagaaatcatatctaggtcctggaatcttcctctttcttcatttacttcttgtctcttcccagggtagccaggacctgtggactgaagagcaaaacaactttcaggggtacattcaccttaacacgtggccctgaatatttgtctctttatttggttctctcaaaccaaggaaacacaagaccctcaatgtaggccaaatgcctttcttcggtgaagtgtggaagtaacatgaagatgaaaggggaggtcacaaaggagaatccacatagcatcatgcctaagcagtaggtaattctcatatcagttttttaaatcaggccatatggatggtgagaaactacattttttcctttatacaatgttactctcacacctctttaaaagtctttatatatatttaaaagtgtttatatacggccaggcatgatggcttacacctgtaatcccagcactttgggaggccgagatgggcagatcacctgaggtcaggagttcgagaccagccttgtcaacatggtgaaacactgtctctactaaaaatagaaaaaattagccaggcatggtggcaggcacctgtaatcccagctactcggagactgaggcaggagaatggcttgaacgcaggaggcgaagtttgcagtgagcccagccattgcactcaagcctgggcgacaaaagcaagactccatctcaaaaaaaaaaaaaaaatgtttatatacacacttcaatatgaagaacaagaaacacatagaaaaaaagagggagacagagaaaaggaatacgagttataaatacaaatttagaaaacaattcaaaaatataaatactgggaaaatagccgcctttatatactaacatacaaaacctgaaacacccataaaaatatgcagtacatttgcaagaggaaggataaaaataggctcttgttaatttgtgcgcagtaatttaaaaacataatgttaaatagaaagcctattcatccgccccccttcacccccaaaaaactttcattttctgcaggttcaagagcatgggttgttgtggaaagccagaggattagaaaactcattgtggaggaggtactcggacctgaaacttttaggaaatgttaacgttcatcaagtctgttccagccaaagtttgagctcaacacacacacacacacacacacacacacacacacacacacacacacacacacacaaaaccagccagggctcttgtgaaaagacttcggctttcacttgtctctagacaaaagaccaccaccccgccagataaaataggaaaacctggaatagacacacacgtacactggattcccttaatgattcatcaatcactaagcctcagattaatccagaatgtgaaacagaagtcacattcgttgacaaaagccaccccatcgattctcaatcactgagccccactggggagtgacccgcgaggaccacaatccctgacctcagtactcttggtcgttgatctattcaggcctttaatcactgaccaccagagcctccatgagggaccccaaagatatcctatcacagacacccaccagggactcctaccagctcccctccaaaaggaaacacccgcccccgcctcccccaacccccgcgctacctccaccatatagcgccaccaacaacgcagacgccctcagaaagctccctcccaccacgtttccacgccctgacccacacactgacctgactctccttggaatcgccgcgacctcttaaaagctgaacttacttccctaaacttcttccacttctgggcccctcgcccaactccctccccctctaaacctccagagacggtcagccgcgtttccatggagagcggaatgcggccttccggcttttcctcaggaggagacgcgtccgcgccggcgtcgcctcgccgctctgggggcggccatctttgagtacgtgacgtacagaaggcacagcggccgggagacgcggtggacggaggcctcttaaactgtccgatttccagacacctcagccctggcagaaaatggagagcttatcagaggcttgagttcacacaggcagacacggcgtgggggtaaagtcctctgaacagacacggaacagaaataagttagtcttctcctcgcaggggacagtgaacggcgcaaacttctcaaaggccagaacccattattaccacaaaggcgcggcatcccttcttagcggttatgatggctgtgacgtctcagctcaatggaaaattaaagtcacctctgggcacctcagtcactattgtaaatgcgaagcgttttagaagccgtataaaaactgaagcaagagagactagaacaaaaaataagcgagcggtgcgttgcaggtaacggagccagagcccttaggggagagcatcatgggggcggccatcttaggggacgttcggtgtccgtacggcagaacatattctctctgagaagcttgcggtggaactggcccatggaaatgtctttagaagagaagaaccacctggctctgttcttgactctggaaaagaatccttttctagaattatttaggttgttgccagattaatttcctttagagagtttccttgcccccacgacttcctatctttaaagccaacaatagtatgtgaaatccctttcatatttgaaaccactgactattgctgctgcatctctccggtttctcctattcttaagtgcttgggcaatccagaataatctcccaatgctaaagtcagctgattaataaacttaattacaatgcagagtcctttttgccatgtaacataaccatgggaattactctggggttgtagatctggctatgatatgatgacactaatgaatattttgcaataaaaacatactattttaaaatatatatatacatatatctttatatatgtatatttctacagaattattacaagttatgtcttatgatggtttcttataagaagcaaggaggaaaaggtccttaacattttcaattgtgttttttttaataataaagcatgcattctaatttacaaaaaccacaataaaggtactttcatcatgtcagtcttgaggctgaacaacacttaacattctttttccttttacctgtctgccttctcccttcccctacactctctataccccaccctccaggctctctgttccatcatcttatgcgtatggcccctttcccctgtgccctcttattacttccatctatcacgcagacacacactgtcactcccctaaacactctagtgttaaacaattgctgctgattgttttttgacaagtgccctatgggtaggagtgttcacataaataaagtcaagccaaatagagaaatactatgagaatagacctattcagcaggctgcaaagcaggcttagtagtgaacattctgtggggatggaggcttttgggtgtttcagagccatttctgccattttcagagccatttctacctcctcaagtgcagatattctgctagggtgcagatattcactgttactgttgttaaaaggtggttgcttttcaaggctaccttgaagctgaggatatggggataggattagggcaagctaaataccacaagctcactgtggccggcattgtagacttaattggccattctagaagaggaactaactggcttctagccagggcctaaaaactagatctagatagccaaaaagattacattaaacttcctctagtgtcccatctatcagattccaatcctgaaggaccaagtcaatctctcttctatttcatctcctttctcccatcttataaaagatctttggaaaactctgtttatttcatatataacagagctgatatttgtatgttttgtggagatgatgtttcatcatgttgcccaggctggtcttgaacttttgggctcaagcaatcctcccacctcgaccttccaaagtgccaggattacaggcataagccaccatgcctgtcttaacatttaatcttttcaaattacttcactatgtattcttttttgttgttgttctttttttctgtttacttcactgtgtattctaagcacaaataagaaattcttatttcctaattattgtttatttccatatatataatatatttttttaataagtttttttttagactgcatctcactctgtcacccaggttggtgcgcagtggtgcaatctcagctcactgcaaactctgtctcccgggttcaagcaattcttctgcctcagcctcccaaatagctgggattacaggtgtaccaccacacccagctaatttttgtatttttagtacagacatggtttcaccatgttgttcatgctggtctcaaacttctgaactcatgtgatccacctgccttggcctccgaaagtgctgggattacaggaatgagctccaacacctggcccatttcctaatatttgtatacacttgctatatttttatttttaccacacataaaaatcaaggcaaatgcaagccatggatcttatacatacaaaggcatgtagaactataatcatatagtgaatattcatgcatactgaggcaggtttttagatgctcagagtctgaaattgcactgcatggtatttccataaaatgtcctggggcatactcggacagaatagctcaagtgcaaattataagcatatattccccaaattgtatcctgtttgaattcatcaaagttgaaatgaaggaaaaaataataagggcagctgtggggaaaagaaagagagatcagactgttaacttgtctatgtagaaagaagtagacaaaagagactccattttgttctatactaagagaaattcttctgccttgagatgctgttaatctgtaaccctagctccaacccagtgcttgcagagacatgtgttgtgttgacagaaggtttaatggttttagggctgcgcaggatgtgctttgtttaaaaagtgcttgaaggcagtatgcttggtaaaagtcatcaccattctccaatctcaagtacccagagacacaatacactgcacaagcccacagggacctctgcctaggaaagccaggtattgccccaggtttctccccatgtgatagcctgagatatggcctcatgggaagggaaagacctgactgtcccccagcccaacacccataaagggtctgtgctgaggaggatcagtaaaagaggaaagcctctttgcagttgagataagaggaaggcatctgtctcctgctcatccctgggaatagaatgtctcggtgtaaaacctgactgtatgttctgtttactgagataggagaaaaccaccttagggctgcaggtgagacatgctggcagcaatactgctctttattgcaccgaaatgtttgtgctcgtgcacatcaaggcacagcagctttccttaaacttatttatgacacagagacctttgttcacatgttctcctgctgaccctctccccactattaccctattgtcctgccacatccccctctccgagatggtagagataatgatcaataaatactgagggaactcagagaccagggccagctgcgcaggtcctccatatgcagagcgccagtccctggggcccccttttctttctctatactttgtctctgtctcttatttcttttcctggtctctcgtcccacctgacgagaaacacccacaggctgtggagggggtggcccccttcaggcagccagagagaaaggtcggcttacccacaaagggaagcccatgtgactaacagcagatctctcagcagaaaccctacaagccagaagagagtgggggccaatattcaacattcttaaagaaaagaactttcatcctagaatttcatatccagccaaactaagcttcctatatgaaggaaaaataaaattctttacagacaagcaaatgctgagagattttgtcaccaccaggcctgccttacaagagctcctgaaggaagcactaaacatggaaaggaacgaccggtaccagccaccacaaaaacatgccaaattataaagaccatagatgctaggaagaaaccacatcaactaacgagcaaaataaccagctaacatcataatgacaggatcaaattcacacataacaatattaaccttaaatgtaaatgggctaaatgctccaattaaaagacacagactggcaaattggatagagtcaggacccatcagtgtgctgtattcaggagacccatctcacgtgcagacacacacatatgctcaaaaaaaaaaaaagggatggaggaagatctaccaagcaaatggaaaacaaaaaaaagcaggggttgcaatcctagtctctgagaaaacagactttaaaccaacaaagatcaaaagagacaaagaaggccattacataatggtaaagggatcaattcaacaagaagagctaactatcctaaatatatatgcacccaatactggagcacccagattcataaagcaagtccttagagacctataaagagacttagactcccacacaataataatgggagactttaacttgccactgtaaacattagacagatcaacgagacagaaagataacaaggatatccaggaattgaactcagctctgcaccaagtggacctaatagacatctaccgaactctccacctcaaatcaacagaatatacatttttcctagcaccacattgcacttattccaaaattgaccacatagttggaagttaagcactcctcagcaaatgtaaaagaacagaacttataacaaactgtctctcagaccacagtgcaatcaaactagagctcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctcttgacacagttaaagcagtgtatagagggaaatttatagcactaaatgcccacaagagaaagcagaaaagatctaaaattgacaccctaacatcacaattaaaagaactggagaagcaagagcaaacacattcaaaagctagcagaaggcaagaaataactaagatcagagcagaactgacggagatacagacataaaaaacacttcaaaaaatcaatgaatccaggagctggtttttgaaaagatcaacaaaattgatagactgctagcaaaactaataaagaagaaaagagagaagaatcaaatagacacaataaaaaatgataaaggggatatcaccaccgatctccagaaatacaaactaccatcagagaatactataaacacctctacgcaaataaactagaaaacctagaagaaatggataaattcctggacacatacaccctcccaagactaaaccaggaagaagttgaatccctgaatagaccaataacaggctctgaaattgaggcaataattaatagcctaccaaccaaaaaaagtccaggaccagacagatttacagctgaattctaccagaggtacaaagaagagctggtaccattccttctgaaactattccaataaatagaaaaagagggaatcctccctaactcattttatgaggccagcatcatcctgataccaaaggctggcagagacacaacataaaaatagaattttaaaccaatatccctgatgaacatcgatgcaaaaatcctcaataaaatactggcaaatcaaatccagcaatacatcaaaaagcttatccaccaagatcaagttggtgtcatccctgggatgcaaggctggttcaacatacacaaatcaataaacataatccatcacataaacagaacaaaaggcaaaaaccacatgattatctcaatagatgcaaaaaaggcattcgacaaaattcaacagcacttcatgctaaaaactctcaataaactaggtattgatgggatgtatctcaaaataataagagctacttatgacaaacccacagccaatatcatactgaatgggcaaaaactggaagcattccctttgaaaactggcacaagacagggatgccctctctcaccactcctattcaacatagtgttggaagttctggccaggacaatcaagcaggagaaagaaataaagggtattcaattaggaaaagaggaagtcaaattgtccctgtttgcagatgacaagattgtatatttagaaatcccatcgtctcagcccaaaatctccttaagctgataagcaacttcagcaatgtctcaggatacaaaatcaatgtgaaaaatcacaagcattcctatacaccaacaacagacaaacagccaaatcatgagtgaactctcattcataattgttacaaagagaataaaatacctaggaatccaacttataagggatgtgaaggacctcttcaaggagaactacaaaccactgctcaacgaaataaaagaggacacaaacaaatggaagaacattccatgctcatggataggaagaatcaagatcgtgaaaatggccatactgcccaaagtaatttatagattcaataccatccccatcaagctaccaatgactttcttcacagaattggaaaaaactactttaaagttcatatggaaccaaaaaagagcccatattgccaagacaatcctaagccaaaagaacaaagctggaggcatcacgctacctgacttcaaactatactacaaggctacagtaaccaaaagagcacgatactggtaccaaaacagagatatagaccaatggaacagaacagagcccccagaaatagtaccacacatgtacaaccatctgatctttgacaaacatgacaaaaacaagaaatggggaaaggatttcctatttaataaatggtgctgggaaaactggctagccatatatagaaagctgaaactggatcccttccttacaccttatacaaaaattaattcaagatggattaaagacttaaatgttagacctaaaaccataaaaaccctagaaaaaaacctaggcaataccattcaggccacaggcatgggcatggacttcatgactaaaacaccaaaagcaatggcaacaaaagccaaaattgacaaatgggatctaattaaactaaagagcttctgcacagtaaaagagactaccatcagagtgaacaggcaacctacagaatgggagaaaatttttacaacctacccatctgacaaagggctaatatctagaatctacaaagaacttaaacaaatttacaagaaaaaatcaaacaaccctatcaaaaagtgggtgaaggatatgaacagacccttctcaaaagaagacatttatgcagccaacagacacatgaaaaaatgctcatcatcactggccatcagagaaatgcaaatcaaaaccacaatgtgttacaggaaggcagggaccccaaacagagagaccagatggagctgcggcaaaggaacataaattgtgaagatttcactttaatatggacatttatcagttctcaaataatacttttataatttcttatgcctgtctttactgtaatatcttaatcctgttatcttcataagctgaggatgtacgtcacctcaggaccactgtgataattgtgttaacagtggttctgcttttgccctttgccctgtgatctttgttggacccatatcagtggttctacttttgccctttgcccttttccctcagaaagatgtaatctttgttagacccttatcagtggttctgctttttgctctttgaagcatgtgatctttgtacctactctctgttcttacaccccctccccttttgaaacccttaaaaaaaaaacttactggtctgagactcaggcgggcatcacagtcctaccgatatgtgatgtcacccctggaggcccagctgtaaaattcctctctttgtattgtctttatttctcagccggctgacacttatggaaaatagaaagaaactacattgaaatattgggggcaggttcccccaataacaacgagataccatctcacaccagttaaaatggtgatcattaaaaagtcaggaaacaacaggtgctggagaggatgtggagaaatatgaacacttttacactgtttgtgggactgtaaactagttcaaccattgtggaagacagtgtggcgattcctcaaggatctagaactagaaataccacttgacccagccatcccattactgggtatatacccaaaggattataaatcatgctgctataaagacacatgtccatgtatgtttatcgcggcactattcacaatagcaaagacttggaaccaacccaaatgtccatcaatgatagactggattaagaaaatgtggcacatatacaccatggaatactatgcagccataagaaaggatgagttcatatcctttgtagggacatggatgaagctggaaaccatcattctgaacaaactatcacaaggacagaaagccaaacaccacaggttctcactcgtaagtgagaactgaacaatgagaacacttggacacagggtggagaacatcacataccagggcctgtcgtggggtgaggggagtggggagggatagcattaggaaagatacctaatgtaaatgacgagttagtgggtgcagcacaccaacatggcaaatgtatacatatgtaacaaacctgtacattgtgcacatgtaccctagaacttaaagtataataaaaaaaattaaaaaataaaagattaatgggccagggttgtggctcatgtctgtaatcccagcactttgggaggctgaggcaggtggatcaactggggtcagtagttcaagaccatcatggccaacatggcaaaacgtggtctctactaaaaatacaaaatttagccagatgtggtggtgcacacctgtacacacttgtaatctcaactactcaagaggctgaggcataagaatcgcttgaacccggtaggcagaggttacagtgaaccgagatcatgccactgcactccagccctgggccacacagcaagacttcgtctcaaaaaaaaaaaaaagaaaacaagattaatgttccctctgaagaataaacatacatagtggggtattctgcagggtgagtaaagtagaaactttatatattcaacccaaagcatattttgttaattagcactgtggccactccactagaacagagtggaaccccacccacactttgatttggatgctgggactgatgacgtcacatagtgaagtatcatgagaatatttgttacataatgagactctggaaagagcaggagacttcccaagctggttcaaaagtggcttgtgagagcaggaaaatgtgttgtgactatggttaaggagtagggcaagggtaaaggtacccaggcatgtcttgaacttccagcatataccaaagaagggagcactcaggctttattatcaacttgcccaaatagtgtggcttaaaagatgtcagtaatcaatcaaaaaatagattcagattctttaattcaacactgaatgtttactcttgaaactcctgacttctaggttgagaaagacttaatttcctcatgctaaaaaccttatacatgtcctttcttcaagcataaataggaccctttacataactgttgaaagtgcttccgaaatactgcttagacaaattgtctacaatatttttacactagtcttgtgaaaattaatgtttataagactataaaaattgaataacaaaaaagccatttttcaaaaagctgtaaaaatttctgtatgaggttatcataataagcatggcattctataatttctcaactatagcaaaacttcatttctattatttatttatttattatttatttatttattttgagacacagtttcactccagcctgggtgacagagactctgtctcaaaaaaataattgttattattattatacactttcctagaaatcatttaacccaatttatagatttacatttgttcccttgtacttcagtgaaaaacttggaggatccataaatcaaggtggtattttcagatttgtgtggcaaaaaatttgtacagagaggctgggagcggtggctcacacctgtaatcccagcactttgggaggccgaggtgggcagagcacgaagagatcgagaccatcctggctaacatggtgaaaccctgtctctactaaaaatacaaaaaaaattagccaggcgtggtggtgggcgcctatagtcccagcgacttgggaggctgaggcaggagaatggcaagaacccgagaggtggagcttgaagtgagctgagatcgcgccgctgcactccagcctgggcgacagagcgagactctgtctaaaaaaaaaaaaaaaaaaaaaaatatatatatatatatatatacacacacacacacacacacagagaaatgacagatgcaaagcatgtgttctatcaatatgtagaaggtcccttacattttaagttcagtgaaataattagaatgatacaagatactgaactgaaattgtacaatgtggaagcaaaagctctgttactaatgtgcaagtatatcaacaggatttttaaaacacaacatgctaattataccttaaaatatatttctcccagtctgggcaacatgacgaaacctcatctctacaaaaaatacaaaaattagccaggcatggtggcgtgagcctgtgatcctgaggcaggagaacatggtctggaggcaggaaacctaaggctgtttcacgctaacgtccttaagctaaattgatgggaaaaccctaactttccacacctaagtaacaaaaggaccagagactactccctttgcaaacctctaccttttctgcctggcagatgggaaattaaaagtacctctgattggttgctttttgcaaccaatcagatatttgcgtaggagtgtgacttttgtaactttacttcagcctctgattggttgactgactgcaggccaccatttcatttacattaggtcagcaccaagcagccaacgggaaacctctagtagtcatttggacccaagaagattctgtatctgggccactgcttgggcctgttcccacactgtggagtgtactttcattttcaataaattcctgttttcattcttttgatgctgcattctttcattgctttgctgggtgtttcttccaagtctttgttcaaaatgccaagaacctaaacaacttgcagtcaagaccctctactggtaacatattctggtgagctagccaggagagaaggtaggcccaaagtttgggatttctttttctcctttccccttttacatacagggaaatcttcctctctccatcttttcctttccaactgaggaccctcagtggacagcacctaagcacaaagacacttgcaagtttctggccagggccattctctggtgaaactggaaggtttccgtgtggaagtgcctaactgccaccgcttggttaaggtgaggaacctgagtccttttcctcgtttttgtttttctgagtcctattcctttttttttttttctgagttattttccttttctcctttttcagtctttcagcggccgtttcctagtagctcgttggtaattgaggggaactgactggggccactctctggtatcctctgaaggccaaggagtgaacagggatggctgccctgcccagaaagggaaaagactcatttctgtccttttcagttataatccctgatccctatgtgtgatgcagttagcagcagcagctcgtccagggcaaactcacaggtttcaggtgacttatgctgcttttatttatgctaaattcttcccttctcccacccaactggcaaaggacagaaaacccacctagctatgcacaaaaggttacacaagtcagagggtccgggcatgtggtctgtgtggtgcatggtggtggagggaattcatgaaaaggaatttattattgcctaagttgagagcgttaaagggttgttttaagtgagatagaaaaactttaagtcaggtcctcagtgatggagggaaccattccaaagtggtgccagcacccatctaaggtcagagatgtctgacagactaagttggggccctaaaggggggatgccccaggtaaaatttgggtcacctaatgagccctccacttttcaaagtcctcttctcttttccaaaccactatgggcaactctccacctattccacctgattccacacttggctacatcctcaaccatggaaatcaatttgaccctgacactctaaagataaaatgtaaaattttttttgcactattgtctgcccccattatgaactgcccagcctggaacaatgggcagtcttggtagccttaattatgacaccatcctgccattagacctattttgcaagaggcagggcaaatggtcagaaatcccatatgcacaggattttatgaccttataccaaaacctagcaatctgtcaaactcccagaacccacccccaccaccaaaggaaagttctaaggtagaattagatattatagatgatcccccccactcttactttttcttttttgagacagagttttgctctcatcgcccaggctggagtgcaatggcttgatctccgctcactgcaacctccacctcccaggttcaagcaattctcctgcctcagcctcccaggtggctgggattacaggcacacaccaccatgcccatctaattttgtatttttagtagagacggggtttctccatgttggtcaggctggtctcgaactcccgacctcaggtgatctgcccagctcggcctcccaaagtgctgggattacaggcgtgagccaccgtgccaaaccagatgacccccttttacaagagccacttgtctctaagggtgaagagcgaccatccctatagcccccttaccaagtgctcctgaggctaaaaccaggagcaaacactggggaccctactaagtcccccaaacactcagtggggaacaccatattctactctccctccagccttgctaccccgtagggaagcagcaggagccgaatggccagtcctattgcaggtccccttctctataactgatatacagcaatgtaaggaaaagctaggaagctactctaaaaatcctaggaaatttgcagaagggttccaaaagttgaccttattactattgcactccagcctgggcaacagggtggtgacatgataataatgtcaatttacaaagatgatttgagaatcttgtctgtatgcacttaaaaccagctgcaaaacatgtgaagcaacaagtgacagaagtgaaaagaatgtacaaatctaggtggagcacagatttttaggttagtgaaacatactccgtatgtttcccatatcccaaagcaacactgtatttgtcaaaggacactctgaacacaacaagctcagtgacttacattgtaaatttacatcattctccaccatattccatgctgcttaactcacacagtacagtgaccttaatcttccagaaaacatggatatgaaggaaccacacctaatgaagcaggccctctcaccttactgatttattcccagagaccacaatgaaagatgtgtaggaaaggcaagacttcatactttaggatgaaggtcacaaatagtcaactagcctttttaagaaatgtcaaagtgaatacaattattttatatactgaattggccatttccacacacgctcttgatcctttgatgtacatattacctggggttttaacaaattttgtcttgtggttattttaccgtatgtatcattccaggtcaatcctggatggagaagcagacttagttatccatagtatgatttacctaacatggaatctgttgagaaattttttttttttttttttttttgagacggagtcttgctctgtcgcccaggctggagtgcagtggtgcaatctcggctcactgcaagctcagcctcccgggttcaaacaattctcatgcctcagcctcctaagtagctgggactgcaggcacgtgccaccacgcctggctaattatttgtatttttagtagagacggggtttcaccgtgttagccaggatggtctcgatttcctgacctcgtgatctgcctgcctcggcctcccaaagtgctgggattacaggcgtgagccaccgcatctggctgagaaatggtttaaaattttaccacgttaattacatttgcaaggtttctatccagtatgaataatttggtaaagcctgaagacacactactgattaaaggtccttccatgttaagcacactgatatgacttttttcctgtataaattctctcaaactccaaaaacatgaacatttgatttttttatttttttgagacagagtctcactcttgtcacccaggctggagtacaatggcgcaatctcggcttacagcaacctccacatcctggattcaagtgattcttctgcctcagcctcccaagtagcgggattacaggtgcccaccactgcccagctaatttttgtattttttagtagagatggggtttcaccatgctggccaggccggtctcaaactcctgacatcagatgatccacccacctcggcctcccaaagtgctgggattacaggtgtgagccaccatacccagcccatttgatttttaaaaaggcttaccacattcgttacatttgtaagactgttctccagtatgaatactctgatgtttccatttggatgttcgggtaaaaagtcttagcacacacattacatttgtcaaagatgtatattctgaggtctagtgagttcagacacctcggggaagcctctagcacatacatttatacgatttctttccaatataaactctcaagtagtgactgaactctggtgaagcttctgccaccctcatttcatttgtaaagcatatctgcactttgagttatagatccacaagttttgacctttaagtagtattcttgccacatatactacacttctgtgatttctctccaggatgtatattcttatgcctagtgaacacttgcttaaaacttagctatattctggccgggcgcagtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgagcgcctgtagtcccagctactcgggaggctgaggcaggagaatggcgtgaacccaggaagcagagcttgcagtgagccgagattgcgccactgcagtccgcagtcccgcctgggcgacagagcgagactccgtctccaaaaaaaaaaaaaaaaaaaaaaaaaaaaaaaaaaaacttagctatattcactccatgtgtaaatatattaggccataattgcatggctagacagaaatacctgaggctaggtaatgtataaagaggtttaattgactcacaattttgcaggctttataggaaacatggcgctgacgtctgttcaccctctcgggaaacctgaggaaggttaaaatgatggtgggaggtgaagggcatgtcacatggccagaagaacaaacaagagggaggtgccattcactttcgtgcgtgcgtgtgcgtgatggagtctcactctgtcacccaggctagagtgcagtggcgcgatctcggctcactgcaacctccgcctccagggttcaagcaattctcctgactcagcctctcgagtagctggtactaccagtacccgccacgaagcccagctaatttttgtatttttggcagaaacagggtttcaccatgttggccaggctgctcttgaactcctgacctcaagtgatccgcccacctcagcctcccaaagtgctgggattacaggcatgagccagacctcatgagaactatcacaaggacagcaacaaggggatggtactaaaactttcttgagaaagccacccccatcatccaatcacctcccactaggctccacctccaatactggagattactacaattccacatgagacttcaaagggaaaggacaaatatacaagctatatgagtaagtataaattatttggggatcccagaggttaggacaacatctaacggcctttccacattgagtttagttgtaaggttctctccagcatgttttatctgatgtttagtgaggcctgagcgactaatgtaagatttgccacactcattacatttataaggtttttcactagaatgaattcgttggtgtttagtgaggcaagaccgccgcccaaacgccttgccacattccatacatttgtatggcttctctccagtatggtttctctgatggtaaaccaagtttgacctttcgataaaagctttaccacattcattacatttataaggtttctctccagtatgcatcatctgatgattaagcagaattgaacgtactctaaaggctttgccacactcattacatttgtaaggtttctctccagtatgaatactccaatgacgtgcgaggcctgagcgataacggaagaccttgccacattcattacatttgtaaggtttctctccagtatgaattctccgatgccttgccagggttgtagtggagttaaagactttcccacattcaatacatttgtatggcatctctccagtatgtcttctctgatggtacaccagacttgttttatgactaaaagttctaccacattcactacatttgtgtggtttctccccagtaggatttctgtgatatcttgcaagttttgaactttggataaaagcctcaccaaattcattacagtggtaagggttctctccagtatgaattaccagatgtttagtgaggcttgaacgctgagtataggctttgccacaatcattacatttataaggtttctctccggtatgaattttccgatgacgtgctaggcatgagtagtaactgaagaccttgccgcattcgttacactggaaaggtttctctccggtatgacttcgcctatgaattgaaaggtttccactgtcaatgaagaccttgccacacacattacatttgtaaggtttctctccggtatgcattctttgatgacgtgctaggcatgaatagtaagtgaagaccatgccacatttattacaatggagaggtttctctccagtatgacatctcatatgaaccgaaaggtatccaccgtaattaaagaccttgccacacacattacatttgtaaggtttctctccggtatgaattctctgatgtacagttagtaatgagccccaattaaaggctttgccacattcattacatttgtaaggtttctctccagtatgaactctctgatgcactgcaagatgtgaatgttgactgaagaccttgccacattcattacatttgtagggtttctctccagtatgaattctccggtgccctgcaagacgtgaacgttgaaagaagaccttgccacattcattacatttgtaaggtgtctctccagtatgaattatctggtgccttacaagttgtgaattctgataaaagaccttgccacatacatcacatgtatatggtttctttcctgcatggattatatgatgtgcagtgaggcttgagttccgtttaaaggttttgccacattcattacatttgtagggtttgtctccagtatgaactgtctgatgagttgcaagagaggaactttgactaaagcacttcccacatcgattacatttgtaaggtttctctccagtatgaattctctgatgaactgcaaggtgggaacttttactaaaggacttgccacattcattacatatgtagggtttgtctccagtgtgacttctccggtgatttacaagatctgaattttgtctgaagatcctgccacatacatcacattggtatggtttccctcttgtatggactatctgatgtactgttagtagtgagccccgatgaaaggctttaccagactcattgcatctgtaaggtttctctgtagtatgtatcatctgatgattaataagacttgaagacactctgaaggctttgccacactcattacctatgtaaggtttttccctaatatgtgttttctcgtcttgtgtaggtaacgaaagttgcaaaaaatcattcccatatttcctagaaatgttggtttggacaccaggaaaaattctttgaagtggtgaagctaaaaaacaattattaactgtcctctcaatttgattacatccataaattttctctgcagtttgaaatttctgcaattcacccagaccggactgaaaccttaatataagctgattttccatatgcttgttttctacgtccccttgactatgtcgaactctttgaccagtaagattgtttttatgggtcatcggcccttctttataatttatttcaccatctttccattgaaagtcaacttcctgtagatttttccggatttccctgaagtaaaaattttcagtgtcatagctttcatgtccttccaacatcactgcttggaatttttctcctgtgttactgttctgtattggtggtaattccttgatcacacatttaggagagatacctgcaaaatataatgaacatggggttttaaaataactattattggtaaatattattttatactgaaaacacactacgctaaacataatgtttatactagcaagttgtgaaacttttctaccatgatcttctatttgtagaaatgcaaaatgaatagaattctatagtaaagaaaaagtgattacatgtaatttaaatcaattttaggaaagcctagtttcaaacatccttcgaccaaaagactcatgttatgcaaacatatatgagcaccaaaacaagtattttgcaatcgctgaccccaaatgacacaccaattggcagtaaacatatggctccctcataataggagagaaaaaaagttacatatatttatttcatacaaatgaatgccaagcaacagcaagatatactgtaatggtaaatattaactaataaataatcataatataaattaattaataaaacattctaatagcctgtgataaaaccagcaggtaaataatgaacaaccacaaaatacaaatctatagtatgaaattctaaacaattctccatcaataataagcaagaatttatattctagaggcagtatataactagaaaatatgttgagatcactggcttttaaagataaaagaaaggtaaatatgtctatggccataccaccgtgaatgcatctgatcttgtctgatctcagaaactaagcagtgtcagaactggttagtacttggatgagagaaaggtaaatatataaaataataaagaataaaaattggggacaggtcagccgggcacggtggctcaagcctgtaatcccagcactttgggaggccgaggtgggtggatcacgaggtcaggagttcaagactagcttggccaacatggtgaaatctcgtctgtactaaaagtaaaaaaaatcagccgggtgtggtggcacgtgcctgtaatcccagctactccggagcctgagacaggagaatcattggaacccaggaggcggaggttgcagtgagccaagatttcgccactgcactccagcctgggcgacagagcagtctcaaaaaaaaaaaaaaaaatggagacaggtatggtggctcagacctataatcccagcattttgagaggccaaggtgggcagatcacttgaggccaagagtttgagactagccaggccaacatggtgaaacctcatctctactaaaaatataaaacattagccaagcgtggtgatgcatgcctgtaatcccaactactcaggaggctgaagcacgagaatcacataaacctgtaagggggaggttgcagtcagccaagatcacgacactgcacttcagcctgggcaacagagcgagactgcctcaaaaaaagaataaaacttgggaaaggaaatcagaaatctcagttatgatttcatgcctacaactatgtaacaaacaacagagcaagtccctatgtattcattgtctttttttgcttttggctgagatggagtctcactctgtcacccaggctggagtacagtggcatgatcccacctcactgcaacctccaactcacaggctcaagcgatcctcccacctcagcctcctgagagctgggaccacagatgcatgccatcatgcccggttaatttttttgtagttttggtagagatgaggttttgccatgttgcccaggctggtctggaactcctaagctcaaacaatctgcccacctctgcctcccaaagtgctgggattataggcatgagccaccgtgcccagtcctattcactgtctttattatccagttccttggccacaaaatatatatgatacagagattgtacttggaaaatgcatgaactgagataaaagacaacaccgtttggaccaaactgcaaaatgaaaacttacagatacaatgtagactgctctgatataaagacttatgtctgccaaaattcctatgttaaggccccatcctcaatgtgatagtatttggaagtgtggtctttggaaggcaattaggtcaggatggtgcatagaacttcaggaatgcaattagcagaaacgtgaaaaagcctctgctttttgcatgacaatctctctgccacatgagaacacagagtcagccatggcacaccagaaaaaagtccacaccaagaaccaaagtggctggctctgacatgttgaactttgcaccacccagatctgtgaaaagtccatttctgctgtttaaaccaccctatctatggtatctgatatagctagtcatgctgactaaggtaaagccaatatgctatctcattataaacatgaaacaatgttgatacacgttattaaacaaatttgtgagtctgtactataaaacatgcaatattctaagctagctaacagcattaacttgtttaaaaagtctttaggtaaattatcactatttaacaaacaagcacactaaatatgcccacaggatttatgtatctatacccaatttacaaagaaagtaagacacaagaacctgggtttgcaagatcaaacatgttttttaaaaacaacttcccaaacaagcagtgcagataacaggtcaacccaaatatcaagagtgtagaaatacttcaagagccattttgtgtagagcacctgattctgtcgctgttcagggtgccactatgtaacccacatggacctaggaggactgaacaaagggggcgaatgcgggaataaaagacaagagacaaaagagtatatttggaagaaggggtcaggggcaccttgcctgtagtggacaagggccctgagctttacacagccgtccgtatttattaggcaagagagatagtgagaaggatggtggaagaaggggtcagctgcgcagtccagagtaggcttgcaagactgcattcctcaaacaacaggctctagatatggcagtagataaccctggcaccaggaagtgattgcctccagcaaaccttctgtcagcaggagcagtcatgagtttgcccacatcctgcattcatgataaacagtttgctgtttgatcatatagcctccagtggaatgctgagttggtcacgtcccacaggctttggctccctgcaatgctgtgttgccaaaagcattattcagccatccgtcatgaataacgaacggtatctgagtcatcatcccctgcacatattgatttacgcagtgttatcagacagtggtcaagtgaatgagtaggggtcaccccttacagagtgagagtagcatgggaggtgagggagttctgcaataatgggagtataaaattaatatgctagtcagtaactgggtagtccatctggacaaagtaatatgttaggaaaggcccaggaggacaaagggcaagaggggagatcaaggagtaatgagcatggagcagcagggtttgtgcttgaagagctgtgggaatagaattgcacaagaaacagctaaaatcctggctttggaagaaaagagaaactaatgtagaggtagtattgtactgactaatacttaaacatgagaattatactatgggtgcaggacaacaagggaagacaattaaaaaggaggcggtgtgatgatatgggaagaaaacagatttatgtctctataatatttgctatgaaatttatcaaactgaatgtcccataagttctatttccaggtatatgctcaacaaccctacatatcaagagatatgtgaaagactgttcttacaattcaatccttaagaaaaaacctgaaaatggccacgaagaggagatggatgaattcattttgtacacacacaaagacaccacaaaactttactgatagtacaagaacgttaaggagacggggtgcagaatgaggacccgtagcacaacaggcaaagatttgagaaaacaaagaaagcaggagactcttgtcaaggtttaaatatatgttaatggagacacagtatatacgatgaaagtatcctgggatatcaaaaacacaacatggaagcagatctgtaaaaagtcatttctgtatgtaattgaagttaagctgttattagtttaaaataggatgttataaatctaaagtgttttctgtaattgcaacggtaaccacagagaatgtatagaagacacacacaatggaaataaaactatttcaggaaaaaaaaatcaactatataaaaacgaaggcagtaagacaaacagaacaaaaaaatctaaaagagatatagaaagcacttaacacaatggcaatataagtccttttctatcagtaattacattaaatgtaagtgtttatactccacagtcaaaagacagagactggctgaataaatttttaaaactggcttcagctgcacactatccagaaaatactcattttaattcaaaggacacacataggctgaactgaagggatgaaaaaagatatgccctcaaaatgttaaccgaaagacatcagaggtggctaaactgatgtcagccaaaatagactttatgtcaaaactggtacaagagacaaagaagggcattatataatgattaaaaggttaattcactaggaggatataacaatatgtgcctatatagagatcctcaatatgtgaagcaaaattaacgtaactaaagggagaagtagttccacagtaataataagagacttcaatggcctatttttacttataaataggacaatcagacagaagaaaaacaaggaactagagaacctaaactatatatcaagttgaacctaacctatatatgcataacacatcacccaaaaacagtgcaatacaaatttttcagaactgcacatgaaacatttttcaaaagaaatatcggaaaagaaaaaaaattttaaactttttaaagactaaaatcgtaaagcataacttatcccatcataataaaataaaactagagatcaacagcagaagaaaattagattatcaacaaatatgtggaaacaacatactcttaggccggtgtggtggctcacgcctgtaatcccagcaatttgggtggctgaggcaggtggatcacctgaggtcaggagttcgagaccagcctggccaacatagtgaaaccctcagccaagcatggtggcagatgcctgtaatcccagctactcgggaggctgaggcaggagaatcgcttgaacccaggaagtggaggttgcagtgagccgagattgcaccactgcactccagcctggacaacaagagcgtaactccgtctcaaaaaacaaaaacaaacaaacaaggaccatactcttaaacagccaatatgtcaaattagaaatcacaagggaaattttaaaaatctcaaaacaaaggaaaatgaaaatagaacataccaaaacttgtgaatgcaggaaaaacagtgctaagatagaaaatctgcagatataaatgctaacattaaaacagaagatatccaatggaacagaataggaaacccagaaatacagccacacacctacaaccaactgatccttgatagtcaaaaaaaaattgggaaaagacattctattcaataaagggtgctagaaaaactggctagccatatatagaagaatgaaactggactcctatctcttgtcatatacaaaaattaattcaagatgaataacgacttacattaagtcttcaagctacaaaaattctagaagaaaatctaggaaaaacttttctggacaaaatacaagttgttgtttttttttcttttttttttttagagacagggtcttgctctgtcgcccaggctgaagtacagcagtgtgatctcagctcaatgcaacctctgcctactggcttcaagcaattctcttgtctcagcctcccaagtagctgagattacatgcatgtgccaccacacccggctaatttttttgtatttttagtagaaacagggattcaccatgttggtcaggctggtctcgaactcctgacctcagacctcaaaatgatccgcctgcctcagcctcccaaagtgctgggattacaggcatgagccattgctcctggcccaataccagttttttaagagaatttattcttcattgcttgagcatcacgaaaaaaatatataggttttataaatagtagagaagtccctgaagtgtaagaaatgggctaagtttaaaataaagttagatttttaaataatgattcagtataacatgatggacatgaatgtagataggagaatagttattataatacagcatttgttccaagaaagaaaaaaacagtgcaatttgaacaaaacccagcaagctatatttaggaaactgaaacttactacagaaaagcaatgtatgttatataacaaagaacgatcaatctattaaatggtatttccacaattaagatagtaacttaaaaaattatgctcaagatattaaaaatttccaacttaaaaactgtaatcaatttaaccgacaaatatatactttcatagtaggaattaagtcaggtgaaacagaagtaaaaggaataactgatactatcaatacaacattatggagtttctgtaagttttagggaaactgctgctgagctataccatctgtactaaagaaggaaatcttgtaaaatacataaaacaatatgcattccccaacacaacactaccacaatagaaacataaaacaaagaaaactgagtatcctcaaaaatatggaactgattaaataaataaaaacaaagttcatttataatacatgaaaatgcatcagatgaaagcaatggttgcttaaaacgaattttgtggacttaaaaaagataagcctcattcaacttcattagcttcctcaagatcaaagtcgtactcactataaacaaaaatactggggaagaaaagtgtggcatgagcagtggttcaggcaacagccctgcagagatgaagctgtgaacctggacaatgttcttcccgggagaaatttttttttttgagacaaagtctcgctcttgttccccaggctagagtgcatggcgcaatctcagctcactacaacctccgcctcccagatttgagagattctcctgcctcagccccccgagtagctgggattacaggtgcctgccaccacgcccggctaacttttgtatttttagtagagacggggtttcaccaagttggccaggctggtctagaactcctaacctcaggtgatccacccgcctcagcctcccaaagtgctgggattacaggcgttgagccaccgtgcccggcatgggagaaattcctacaccattcactgctagctcaaaaaagaggaccattagtatatgagatcaacattgccacagtacccttgaaagatacttttgtgacatttctcagaaaccaggctcttgtgatggtctctatctgaatatcatgacaaatgctgatcattctactctggctttaatagttacctctgtatgtagcaagatgatgttaaaactcattactcaaagtgctctccttcaaaaattttctcttacccagtaaactcactccatacaatagtccacaagatattcataaccccaagatgggttatcacagcaggaaaaaagcataaaatgtccgaccctagaaatgcatttatccaaagcaagtctcagaggcaaaaaatcacacaaacataaaagagaatgcaagatcagaaagagccaaggcataaacaagacagagaaaaacacaggaattggattgtgagggatcttgaaatgagacagtgctctgtccacagatcccaaactaagagtgtgaagacagagatacgctccctgtgtaggactaagaataaagagaggacctttgtgtcaactgtctttacaattcttatatgtaacaatctcaggagacccaactcattcccgtgtcacaaacccaagaagagtgtccaaagaagaactaagaaaatggctgagggacctgaacaggcagagagggctgaagatagtccagttctaggaccccagcttcaaaggaagggcaaccaatgtttcctcatctcctgaccagcactttcaagtataggaaatggggtggaaccagaaaagttccaggcaccaggactatggagccctcagctccaatctatatggatcagagaactgaggatcagatggaatcaagaacaggaggagagaccacacgggaaagagacttctttgaaaaggcccttcccatgccacagagtcaaagcatcagagttcacacaatacagatgacactgtggtccatcataacagtcttgtactttgctctgtttgagctgcagcaacccctggagagtgaaaggtaaagttatacgtgtctggaaagcaaagtgataagcaggaaagaagaaaacttctggagctcacagaaaatcaaatttgtttccccacagaactctcccacttgcagagtcttacgcacacaatttcatggtaccgcttccattgtgcccatctgagctcttaccggtgatcacgcctttcatgcattccccacagtttgggttcctcgctattttcacttggctcaccacagtccagggctctttcccttgctccaacatggagataatattcaggtcaggaagacagagtcctgcttataaaaaaagaaagaagatgtcccacggtttttccagaacccagcctaatgtctaggtagaagagaaaacactgcagttgaatctacaaaatatttcacaaactcatccattgattgcctccttctgaatgcttagtgaacactgtaagatgaagatatctagctctctcccaagaaatactgaatcaaaaacacagggataggccaagcatactggctcaagcctgtaatctcagcactttgggaggccaagacgggaagatgacttgagcacaggagttcaagatcagcctaggcaacagagtgaaaccctgtctctacctgggcatggtgttgcacacccacagtcccagctacttggaaggctaaggtgggaggatggctttatcccaagaagctaaggttgcagtgtgccaagatcacaagatcacaccactgcactccagcctgggtgacagactgagactgtgtcaaaaaaaaaaaaaaaaagcacaaggatagaaaacaggaagaacagggaattggatatattaactccgccataaggttttacacgtacctcagctctggagtcaccactaatgtacaaagaaggaagcagaatatccatagaaatgggacagttaaaggccagatgcagcattatgaagctttttatttgtgaatcaacaaggcttcagtctctgtcaaataatgtagggcctcacaagaaacacaataaggaaagtacaaaaatgcacaagggaagatcctaacttctggaggaaaactatcctcacccaggaagccgaggttcctgtagttctccaacatcacgtccctgtacaaagctttctgaacagggtccaggcatttccactcctcctgagagaattctacagccacatccctgaatgtcaaagatccctgaaatgaaaaacacatttcaatatgagcagtgggtgagctcttatctttacataaaatgagaagaggagagaactgtcacatcaatttgattgaagtgtgttttgacatatccattaaaagtatctgtgagataattacgtctccctgattttgggttttataaaattcaataggagattaggatattatctaaatcggtgcacatttctcacttttgtggacaaaataagaaataaacacatggttatccctatgaaagttttagatattacatttgttacaccaagtgaggtgtccagatgagctagaatacaagtggtgtcttcagagatgacaatgttcttagtggctttaaagaaaggtcagaaactaaaaacagcgatgacaagagcaacagcaagaactaaagttttggaacactccccatgtaccgggcattacttcaaaggatttacgtgttctaactcaaatgatgacataatcacctatgacagaaatatttcttcccatcttactagaagacaactgtgtcacagacaggctaagaaagtcacctaggtcaacaacctgcaaacagcagagcaagcacctgaacccagatgtctaaaaattagagttgaatcaacagaatccgacagttatattacagagtatgtcctagtctttctgtgtggctataacgaaataagagagactaactaacttatgaacaacagaaatgtatttctcatgattctgctggctggggaatccaagatcaaggtgtcagcaggactgatgtcgctgagggctaatccctgcttcgaagatggtcttgttgctgcataggggacgaatgctacagtatactgacagagggttgcctgagaaaacttgaagcaagttcaagattaacttggaaccgcataaaggatcattatataggctaggcgtggtggctcacacctccatcttagcaccttgggaggccaagatgggtggatcatgaggtcaagagatcgagatcatcctggccaatatggtgaaaccccatctctactaaaaatacaaaaattagctgggcgtggtggtgtgcacctgtagtcccagctactggggaggctgacacagaattacttgaacctgggaggtggaggttgcagtgggccgagatcatgccactgcactccagcctggagacagagtgagaccccatctcaaaaacaaagaaaaaaaagatcatcatataagcacacagaagcacacacataatacattactattcataaaactaatccattcacatgataatatagaaggcaattttaaaaattaagcaaatcactgggacaaagaaatatgtaaaaaagtttttataatcccagcactttgggaggccgaggtgggcggatcacaaggtcaggagatcgagaccatcctggctaacacggtgaaaccctgtctctactaaaaatacaaaaaattagccgggtgtggtggccggcgcctgtaatcccagctactcgggaggctgaggcaggagaatggcatgaacccgggaagcagggcttgcagtgagccgagatcgcaccactgcactccagcctgggtgacagagcaagactccatctcggaaaaaaaaaaaaaaaaagtttttaaagaaaaaacattttaaggccatagaaacatttaagatataattttcaatagtgttcccaagcctgtatcttatgtagagaaaagaaaaaaattaaaataaaaccaagtaaataatttcaactgtgaaaagataataggctgatttatgaaatgatgatgttgtaaataaaaaccaaagcatacaaacatttaaattaactgaaataagacgctatctctcaatgacatattttttggatgactttttaaatcattattcttagacatgtatgttttagcatgcttgggacaatgaaaatgtataaattgtatttcatttactttgtacttagtacttcatttacttatttacttagtacttcatttacttatttattttgtacttattcaatactaggctggagaaaatggtacaaaattttaaaagtatataaacttttattacaattactattaaatgcctatatttaaatatctaagtgcaattttatccagttaaatttagctacttatgcattaacaaaagccaaatggagtttattcgtttattccaccaataaataaaacagtgattcaagattaggtggtttataagtgtaatacattaaaatttaacagattaagatagaaacaatatgtattgcagcagtatatgcttgcataaattattagaaaatttaaaaatcatgttgcaaaggaaatctgtaaaaaaaaaaaaaaaaaaaaaacccaaaaactgttaaggaaaaatatttcacccaacaagtgaaacactggattcatttcctctaaattaagtaagagaaaagggggtttttcatttcctctaaattaagagaaaagggggttggccagacctcctgtcattcaccactgcactggatgtctgagcagcagcaaagagaaaaggtgggagggaaaaaggcaaggagggggtagagccaaagagttagatctactaaaattaagagataacatgattgtggccgggcacggtggctcatacctgtaattccagcactttgggaggccaaggcgggaggatcacctgaggttgggagttcaagaccagcctgaccaacatggagaaatcccgtctctactaaaaatacaaaattagccgagcatggtggcacatgcctgtaatcccagctactagggaggctgagccaggaggatcgcttgaacctgggaggcggaggttgcggtgagctgagatcgcactattgtactccagcctgggcaacaagagcgaaactccatctcagggaaaaaaaaaaaaaaaaaaagagataacatgattgcaacccagaaaaagaatgtttaagtatacaagctaacaatgctaacaatgtactgaaataatcttcctactttagtaacactaatttaaaaacaacacacacacttctaaattttcattagcatatataccatggcacttaagtacaatacattttcagaattatgtgaacaaattataaaactacactgagtgatgtcggcaagataaaggaacaggaatccccaaactctccagtcaccacagtgaaatgattttaacaacaattcatggactaattgcctcggggataaatccagaaaacagttaggaggtttctacacctcaggctgacataaagcaaacagtatagaagctctgaaggaaaatttgaagcatccacttgacagagatccagcccctgccatgcactggggtaacagaaaagaaacccacaactcccaagatcatctaggggatggaaaggagcagaatatctgtccaacttcctgacttttcagatgaccaactgatgggctggtttctctcttcctgaatataagcactgacaagaacaaggtgaaaggttaggggccactgagaaaaaggatgatttacataaaccagtgtgtgcagtaacacagacaaacgctaagtgcatatctagtactacagcttactgtagcaccaaagtctgcaatatcaaagacagacaacaggggagcttctgggtagaaactagcaaacattttcaatgaagagatgacaagcaaaggcccagagaggacaaaatccccagccagaaaaggtgtggaaggtctccacaatctagctgagttgactccagagtgtcctccctgaacaaagcaaccacccaaaactggggaggtagatgatttttaaaatagggaagtgccaaaagaagataataaaacttacaaagaaataggaaaatacagtccataaaaagaaaccaattaagtctctacaaacctacactaaagaaatggtgatttaaatcttggctttgaagaactaaaaggaaatggggatcaccctcagtatatgcagaggattggttccaagattccctaaggggaccaaaatctatggatactgaagtcccttatataaaaaggcatagtatttgcatataacctacctatatcttcccatatgatttaaatcatctctacattacttataatagctaatacaatgtaaatgctacataagtagttgttatactgcattgtttaggaaataatgacaagaaaaaaaggaccatacgtgttcaacacagatgaaaccatccatttttttctggctatttgtagttcatagttggctccatctatggctgcacgagccatgaatacagagggctgactatatgtgaattaccaaagaatttgaaatagcagccacaagaatgctcaatgagttaaaagatagcacacacagacaagctcacgaaatcaggaaaactatatgaactatgcatgcaaagaagaatatcaacagaaatagaagctataaagaaaaatcaaaaagaaattctaaggctgggcaccgtggctcacgcctgtaattccaacactctgggagcccaagatggggtaattgcttaagcccaggagttctgagaccagccagggcaacatggcaaaatcccatctctacaaagagtacaaaaattaggcaggtgtgatggtgcatgcctgtagtcccagctactcaggaggctgaagtgggaggttcatttgaacccgggaggcagaggatacagtgatccaagatcgtgccactgcactccagcctgggaaagagtgaaaccctgcctgaaaacaaaacaaaagaaagaaaaaaagtcgagttaaaaatacaataactgagttgaaaaattcgctagatgaattcaacagctgacttaatgaggcagaagaaggaatcagtgaactcaaaggggattttgacacggaggaaaacaaaaactataaaaaataaagaaaaataaagagagtctaaagggctcatggggaaaccatcaagcatcaagaacgtatgtatcctgaaagcccaataaataatgtgaatatacctaacattactaaactgtaagcaaacaaacaagctttactgaaagacataataaagatatgatcactgactgacaaactcaattcttataggaagatgtgatggtgacaagacctgcgactgtaaaaattcatggccattcaaacacaaacaaaatatgtgggaatttaataaaatgtgactgttgtataaaaaaagaaccaacaaaattttggaaagaaaatggagaggtttgccaatcttcatatgaacctattatgacatttataatctgaaactttaaaagcaatcaaatataatctacaaaaagatatacacaaaaattcaaattaaagattcaatcaaaaaaattcatgcaaagaaaatgtaagcaagaaacatgagattttaaagaaacttcatattttataatcacaccgtgagccaggccttccagaagataaaacaaacatttacttatttttgcttttgtggtataccatcctaaaagaagcaatcattctttgaactgccattgaagtaaccctcagacacttgtggtgaagacagcatgcacagaggaagccacagtgacattctttgcaaaaatgaaaaattgtaaaagatccatatgtcttcatttagaaattgctccaaagaggatgcaaaatacgctattagtgtttattaacataaaaacatgtacatttcaggctgggcacggtggctgacacctgtaatcccagcactttgggaggctgaggcaggcggatcactaggtcaggagatcgagaccatcctggttaacacggtgaaaccccatctcaactaaaaatacaaaaaattaactgggcacagtggtaggtgcctgtagtcccagctactcaggaggctgaggcaggagaatggtgtgaacccgggaggcggagtttgcagtgagctgagattgcgtcactgcactccagcctgggcgacagagcaagactccgtctcaaaaaaaaaaaaaaaatgtacatttcaaaaacttgcaaaatacagcagaacattcacttaagaattgttttctaaaatctcataatgacgtgtaaatgcatcttgacacctctcactgactcttgccacagaacttacaatagtagctcctcaatgaaacatgaggcatggtggagaatgtgacagggaaaaggaacctgggttcctctgggtgggtaattgaaagagtgattgcctcttctaggatggtgcatttcctattttggtgaatctggcaagattccccactaccccaagttcaagggtgccccctcccaccaatgacacatgacatgtcccactctttaaaaaaaaaaaaaaaaatactactatgttcttttttctctttgaggatctaaaaaaaataaaaattctttgtatttccattttccaattccttggactgtgaggacatttcattattttgtggaaatcaaaataaaataattttcattttatgctcaattttcttttactgcattctaggagctatttcatgttctgtagttaaaagtttttaaatatatatgccttgatgttctttttttaggttatgaagggtgttcttgatgccctgttttttacttgtttgcttacaaattttattgtgtatatttaaggtacacaatatagcaaggtatagatagtaaaaaactcacgacagtttaacaaattagtatatccgtatctcatagttaccttttttttttttttgcttttgtggcaaaaacagctaaaatctcatttagcataaatttcacatataataacacgttattccctaccatccttatgttgcatcaccttcttaatgtctaaattccatctctgcttggacttttaccacaaaacaaatatatatatcatgtgatgtttaaaataaatgtaatatttaataataattggtggaatgacagaatttggctccatcttctctgacatcaaaaaagtttggctcttacatctgagcaaaattataaccgttttacaaaaaacaactgccggtaagagtcccagcaggaacaccacattctctgtgggatggatatgctgagaatggctaaattaatctgacattcaggttgatttcatattttaaaatcaatgatggaataaaacaacctctatcactgatgtctgtacctagttttccattccattcccggtcattaagattgtggagttagaaagagtgactgattcattatagcttcaaatgtggtataaaatcaggcagaaaagatctccccttagaggcatcttttcaagaatttatgaggtatttttgcatattaacatgtgacttccacatacagcttctctactcctggtctactgagagctgacagtgcattcagatgttgcccctaaacaatctctgctgcccaaaagctgacaccacagaactcacaccctgtctccatccatgtctgggtgtgagcccttcccaggaccatgcccagtggagcctcttcccaagctcatgtcactgagtcactgtgagatctggaatctaagtgcagaagagagggactgaaggaaggcatgggtgagtgcgagcaaatgtgtcaggcaggatacttcagactcagagaagatttgcagctccaatgccctgcatttcaaaaagggaggagacagaacaatccaccaagattatcactttacctgaggaagagccatccctggctccttttctttcttctttctctcctgggcctctctctcagtcaatataattaattctttaaaagtcaaatctgaaagtcaaaaatatgttgtttaatccttggaaacaacacattcctttctgtgccacaaccatgcccacagggaaggcctcagcatgtggagagacagcccagtgcaccagggggatgcaagcataataaactcctacacaaagaccaagtaagtttttcacccttttcttcagaacttgttcccctcccagagaagcccccacacaccctgcaacagtggggagctgggctggactatgcttcccttcaggacacagacccatccctgatcaaaccccatacagagcacagccccctcacctccctgtggatcacaggctgagctcagctctcagaaacagaagacacaaaggctggacgctcaatgctggatacaaattagaatcaatttgggtactttaaacaatatggaggttgagtccatcctacctactggaagtggaatctatggtaaaagggcacaaaacgtgtatttgcaaactgcctcagcacgctaatgtgaagccagggttgaacacatcttaaagggggcaagactagcacagccccatcctcccagctctgctgtccccttggggcttcactgttaccagtttgtagacagtagaacacaatggaccagaaacacagagacacataatatgcaccaggggtggggtgagggtgtggctggagtgttaaatggtgagaggagggtgaggcacagaagtcccaatggagaaggtgatatcagaacaaagacctcaagaaggaaggatgtttgcacctgcagctgaggggccagacagcccaggtagaggccctgaggcaggagcaacctcagcccagggaacaggaaagaggcctgtgtggctggagcagagggagcaggaaggacacagggaggagatgaggtcagagaggttctggggagcagattaggtagagatgaggtattcaaacatctttctcccacagctcacagtaatttcagaaactatgcatttcctcaccctttttaagtaaacataacttttctttatcacatgaattaaagcacttctttttaatgtcatgttttctctgtttcaaatatatgctgacatgtaaagctaaagccaggaagtacagggtcaccatcatctgagatgtgcaggagtgcaggggaatgtacttggtgagttcaggcaatcacttttggtggagatacctgttagatggctaagcagagagaggagaggacaaaaggacacagaattctagagttcaggggacaggtctgcaggggacatggagacgtgtaggtgggtaggtgggtgatatggatcagctctgtgtccctggcccaaatctcacactgaattgtaatccccactgttactggtggggcctggtgggaggtggatggatcatgggggtggatttgtgatgaatggtttcacaccaccccttggtgctgttcttatcatagtgagttctcacgacatctggttgtttagaagtgtgtagcgcctcccccctcactctctcttgctcctgctcccgccatgtgagacgcctgttcctccttcacctgccatgactggaatcttcttgcagcctccccagaagcagatgtcgccatgcttcctgtgcagcctgcagaactgtgagccaattaaacctgttttctttataaattacccagtctccagtatttcattatagcaattcaagaatggactaatacagtggggtttaaattcataagatgagatgatgaggaaagacagtgggtgtggacagaaacaagaagaggttcaaggactaagccatgagtcattcccacattgggaaacattcagagtcaggacacagcagcagaggaaagtgtgaaatggtcagggaggtgacaagaaaatcaaatagctcctgacaggcaaagaaagagtaaagcaggaaatgaaatacattggatttagaaatggggaggtcactggtgactctgaaaaataaagttatcagtggaatggtggatatgaaagtttcatccaatgcattcaagacacaattggaggcaacaagtgaagacagagactctgaacaagattgtattgtattatggtcttaaatgaagcacagaagaggggtactcactacaggcagaaacacagttaatggtatgttttgttttaattagggcacagtggaaggaaactagaggctttagggtctgtgtgtgtgcatgcatttaatgggcaatacaccaccatcagtaaacactgtttaaagtaattctgtagaagtaaaaatgaatgacacagttaaacaaattttatggaagcccaaagtattttcgttgttttctttttaacttatattttaagttcaggggtacatgtgcaggacgtgcaggctggttacataggtaaatgggtcatggggatgtgttgtacacattatttcatcatccgggtattaagcctagtattcataagttatttttcctgatcatctccctcctcccaccttccactctcaggtagatcccagtgtgtgttgtttccctctatgtgtccaagtattctcatcatttacctcccacttgtaagtgagaacatgcagtatttggttttctgttcccgtgttagtttgctaaggataatggcctccagctccatccatgtcctgggaaaggacatgatctcattgttttttatgggaaggctgttgttttggactagcctcccgaactaccagaccaagccagaatgaagtctcttgtgctgagtgccacattatcaaactgaaccttgaaatgggccaggtttaggggaaaaaaaactccaaaaaataaacagagaggcccggcgcggtggctcacacttgtaatcccagcactttgggaggctgaggtgggcaaatcacctgaggtcaggagattgagaccagcctggccaacgtggtgaaaccccgtctctactaaaaatacaaaaattagctgggcacggtggtccatgcctgtaatgaccccacccccgaatactggcaccactatctactaaaacagatatcttcaatgatgcacacatgccccaatgagaccccaacatcttccaaggaaactctccatattgacatttagataatgcatccaaaatgcatctataaccatcttaacgtgcagcccaaaatactccaaaaaaaaaaaaaaaaacaaaggtagcccccctaaatgatctctgtgattttccagataatacttcggtaagttgcatgattcctgcactcccaaaagaccccgcagaagtcaccatgaaaagtgcttatggcagtacagttctgggttccacgctctcaagaccaacgaaccaaccctccagctgcccaacctccctgtggactccacttaggccttgcttctcacttcagttgacgatagaacaatatgagtttggattgtatgggtccatttataaaagaatttacttcaataaacatctgaaaaatattttgaagacttgcaacaatttgaaaaaactcacagatgaaccatgtaccctaattaagaaaaaggtatgccagaaatgcataaaatatatgtaactattagtctattttatcacttagtaccataaaacacacacaaatctattctaagttaaaatgtaccaaatttatataaacacctctagactgtatatggttccatctacagtcaaaataaatgtaaaaaaatgtaaagacgcagtattcaatcataactgcattaatgaactgtactacatactgaacttctataataatttcatagccacctcccattgctattgtggtgagctcaggtacctgcttaatgtgccccgtgatgttaatcatctccatgtgaactgttaatctctctagtaaattgcagaccgcagtaaaaattgatctctgtggttctggcacatttttcattgtttggtgcaatacgataaactctgaataacaacacaggacccatctgaagtgccactagtgatgctggaagtgctcccaagaagtagagaaaagccatgacattataagaacatgttgacttgcttaatacgtaccatagattgaggtgtgcgattcagttgcccgccatttcaagataaattaatctggtgtaaggaccactgttaaaagagaaaattcatgaagccgtcactgcagctacaccagtaggcacgaaaacaatgtactttttgctaaataccttttttatctcatattgaaaatgcagctttatacaggggcaaaatcactataatgaaggcatacctgtagactctaatatgatttgagaaaaagggaagttattttatgacaactttaggaaggtaaaggatctaaagctggagagtttgatgccagcaaaatatggactgataatttaagaagtttggcttaaaaaatgtcaagataacagaagcagccactccaaccaagaggcagtagatggggtcccaaatgctatgaagaaaatcattaatgagccaggcatgattgctcacccctgtaatcccagcactgtggaaggccaaggtgggcaggtcactagagcccagaagttccagaccagactgggcaacatggcaaaaccccgagtctactaaaaaatacaaaaaaaaacagccggacatggtgacacacgcttgtagtttcagctactcgggaggctgaggtgagaggatgccttcagcccgggaggcggacattacagtgagccgaggtcacatcactgcactccagcctgagcaaccgagcaaaaaataaagaaactgtggcattccaaaatgatccatgcacaaccactcataatcccacttccaagtgcttctgccagacctaagaaattcctttccaagagttccacataccccttgctcttataaccacacttgggacaggtgcacacaccataccatggctcatctgaaggcccacccttgctttctggagccttctatggactcccctccattttcccccatttttctacctctcctccatgcatgcatgaacaaactaggctaaaaggtacaggatctctgggcacatgcaacacagcaggagtgtacacaaactgcaaactgaaggaccctgggccttcagtatgaagaccacaaagttgggcctgctgagaaaacttgccagcaagtgctgacaatattaagtctagtttaaaggcagctgggcattggctagattaagttcagtgaggatgtctcagaagaggggccctaaatctttctatacactaaagacaaaatatctgaaaaaagaaataaagaaaacagtcctatttgtaatagcatcaaaaggaataaaatacttaggaacagatttaaccagtgaagtaaaagatctgtacactgaaagctcttaagacactgataaaagatattgaagaggccaggaaagtggctcatgcctgtaatcccagtgctttgggaggctgaggtgggaggattgcttgaggtcaggagtttgagaccagcctgggcaacatagtgagactctttctctacaaagaaaagaaattagccaggtatggtggtgcatacctgtagtcttagcccttcacccaggtatggtcgtgcatacctatagtcttagctacctgggagcctgaggcaggagggttgcctgagcccaggagttcaaacctgcagtgaggtatgatcgccccactgcatgccagcactccagcttgagtaacaatgtgaggctggtctcttaaaaaaagaaagaaagaaagaaagaaggaaggaaggaaggaaggaaggaaagaaagaaagaaagaaagaaagaaagaaagaaagaaagaaagaaagaaagagaaagaaagaaagaaaaaagaaaggactgtagagagccaaaagccaaagggtcatgaccaactctgcattccactgaaggctatatgattaaacagcaaactgtttatcatgaatgcaggatgtgggcaaactcacatctgccctgccgccagaaggtatgctgagtgcaattactccctggcaccatgctccttgaggttatctactgaaacatctggaggctactgttcagagaatgcagtcgtgcaagcctgcaccaagtcaagcagctgactgacaaccacccgcttctccctatctcctttactcaataaatatgaagggctctaaaagctcaggactcttgctcactagaagcaaggagcccctgaccccttcttccaaatatactcttttgtctttgtctttattcctgtgtccgtccccctttgttcagtccacaggcattggggctgcaacaaaggataaaaaaaacattgaagaacacacaaagaaatggaaagctatcccatgttcatagattgtaagaatattttaaaatgattaaaatgtccatactaccaaaagtgatctgcaaattcagcacaatccctatcaacactccaatgctatttttcacagataaaaaaagaaaaaaccctaaaacttttatacaaccacaaaaaactccaaagagccaaagcagtgttgaaaaagaacatgctagaggcatcatactttctgatttcaaactatattataaaggtacagcaatcctaacagtataatactggcataaaaacacacagagaacaatcaaacacaagagagcccagaaataaacatgcacatatacaactagcctttgacaagggcaccaagaatatacaatgaggaaaggacagtctcatcaataaatcctgtcgggaaaactgtatattcacattcaaaagaatatgaaactggacccttatctcacactatatgcaaagataaactcaaaatagattaaagatttaaatatatgatctaaaaccgtaaaaccccagaaaatagaaaaaaagctccttgacattgatcttggcaatgatttttttggatatgacaccaaaagcccaggcaacaaatggtgggactacatcaaactaaaaagtgggactatgtccaactaaaaagtttggccaggcgcagtggctcatgcctgtaatcccagcactttgggacgccaagacaggcagagcacttgaggtcaggagttcgagaccagcctggccaacatggtgagaccctgtctctactaaaaaattagctgggagtggtggtgcaacctgtaataccagctactacgggggctgaggcaggagaatcatttgaactcggaaggcacacattgcagtgaactgagattgagccaccacactctagcctgggcaacagagtgagactccattttgggggtggggtgggggaggggcaaagctcctgcacaccaaaggaaacaatgaactaaatgaaaaagcaatttgtaagatggaagtatgtatctgcaaaccatatatttaataagtggttaatatccaaaatatataaaaactcctacaattctacagcaaaataccccaaataatctcaataaaaatgggcaaaggacctgaacattttccaaataagacatacaaatgaccaacaggtatataataagatgctcaagatcactaatcatcagaggaatgctaatcaaaaccaccataagctatcacctcatacctcttacgaaggctattttaaataggcaagagataacaggtgttagcatgatatggagaaaaatgagcccttgtacactgttgctgggagtgtacatcagtacagccattatgaaaaacactatggacattcttcaaaatattaaaaatagaacaacaatgcaatccagcaatcccatttctgggtatatatccaaaggaaataaatgaaaccagtatctttaagagacatctaggccaggcatagcagttcatggctgtaatcccagcactctgagaagctgaggcgacaagatcacttgacaccagtagttagagatcatgctggacaacatagcagagaccatgtatctgctgaaaaaacacagacaaaaacaaaaaaatggctgggtgtggcggctcacgcctgtaatcctaacactttgggaggccaaggcgggcagatcacgaggtcaggagttcgagaccagcctggccaacatggtgaaaccctgtctctactaaaaacacaaaaagctgggcgtggtggcgggtgcctgtaatatcagctactcgggaggctgaggcaggagaatcatttgaacctaggaagtggaggttgtagtgagctgagattgcaccattgcactccagcctggacaacagggtgaggctctgtctcaaaaaaaaagaaaaccttacaaaatatctgtcccccatgatcactacagtattattcataacagccaagatatggaaacaacccaagtgcccatccatgaataaatatgtgtgtatatagacatatacagagtgttcatgtgtacatatatataatggaatattatccaaccctaaaaagaagaaaatcctgctatttgcaacaacatggatgaacctggaagacattatgctaggtgaaataagacagacactaaaagacaattactgtatgacctcacaagtggaatctaaaaaagtccaattgatagtaacagggtagaacagttgttgccacaggctgctggggggtgaaaatggaaaatgttggttaaagggtacaaattttctgttataaaatgaagaagttctgaggaagctaatgtacaccatggtgactatactatattggacactttaacagtttggaaagtttttgaaaaatctaataaattatggggtaaaagttcaaaaaatgatggcacttaatattcagaaatgaatgagatcagctgattattggatgccaccaaatcttatttctggagttagcaactataggaaagaagcaattgaataaaatgtatctcaagcttccaaaataacaattaattaactgtaaagcaactacaaagaaaaaagtaaattcattacaaaaaaacaagactttcaatgcttctgcgaagacataccttgtaggcctagtgtggtggctcacatctgtaattccagtgcgttgagaggctgaggtggaaagactgcttgaggccaggaagtagaagctgcagtgagccgagatcatgccactgctctccagcctaggcggcagagagagaccatgtccccccccaaaacaaaacagaacaaagccaaaaaaaacaccaaagacatatcttgtagtgacagtcagtcatttcttgccccatttctcccctcctttatgctctactccatcattgggaagaagagagttaccacaaataactggatcaagtcactgccctctggctaaataggaattccaaatatcttttgatacaaatacatacaaaatgcacaaggcttatagaaaaaactttggtgattttcatcctcatgagtacaacttaaacatatttcaaatcagagtataaagccacaaatcaatatattacaaccaccatccatatccaatcaactgtcacgcatctggatggggtcctctcccgctttcttcacggctatgtgtttccctctctcattctgagcgtcttttttttctccttttctgttttgcacccctttctttattccctcttttatgtctgttctgcccaatgctctgcaacttacttcacctctcgtagctctttctccccaatctttccgattgtccccaatctccacgtatttctgcctcttttcccccatctaagctccctctctgctctccttgttaaattccctcttccctgttacatctcctttgttcccactctctagcacccccaatttcctaggcttactccctgctgtggttctccctctactctgcttgtcacccactgccctctctccctctctttcagtcccagcaccacgtagctctgtcagccgcggctccaactctttcaccttctccccactgtctgtctgtctgcagtgcctcctcctttgccgccccactctattttgctgcccttcatctctctgaaggtcccctttttttctaaatttctctgtgtgcttttctccccctgctactttttccatccgttctctttcactcttgctctctttgcaagtccctaaagtatcatccattttgccgtgtatttatgggtctccctcattcttttctcctcagtttttccttttgctccgtcgttccccgtcttttcctctcctgatccctctcacccacacattcgggaggaaaggggaggaataggatgcccacctcccggaagagcacattttccagtggagtaaaatttgggaaggaagaacactgggtgtcacaagacagactcaggtaacctgtcccaacggggagtcaagaaaagcagtggctgtgaaggggaagcctggggagcggaaggacccggcgtgaggacgacacgaggtggcgcggagaacgatgtctcacgacagggagggtctgcagaatcccaggacgtgggaggagaagcggctccttcaggagccggacagtgggcgctcccctccaggggcagacgacggaggagctcggggatcgcgaagggcgctagtccacatcccgaatgaggactcgacttggcgcggggcccaagcagagggttttaagcgggaacactacctgaatggggttgtctacatggtcctaaggaagaaaggcagagagcaaggaacggcctcagagagattttaaaccgaaagggaagcaattctcctacttacttgggacgaaggggctgttgcgggtattttaaggtccgtagcgatccccaggtcacgggtatggagaaccgaggactgcgaagtgcacgtttaatcaaggtagacgaagagaagcaaacgtttaatccaggtagactgaaacacactcatagcgacgtggcctttccccagcgcgatctgcttccgggtgtgcaggaaactgggcgcggaaagaaaaactgggcggcctgggggcggggcctaggcggggcgcgactaggaaagggctgggcggaaagactggcctgacttgggagtggcccgaaagggtggtgggaggcccagggcggtagggggcgtgactaggtggggcttggctggaccgaaaactgggatgaagcggggcctccaggggtgggcggggccgaggcggggcctgttctccactccgcctctcacccagcaggattttgttttccaggtttgggagtatttgtgactatttcttgtcctgtgaagcagcgttgctccttgcccattttaaattaatgtttcagaatttaaggttgaatcttaaagttgtggtccacttatactggaaactaagatgatttattcttaacaagttgaactgatttaagtcaaaaccgatttttccgagcctggtggactccatccagtcttaccagaaaagctgaagctactcagtagtcagggaactgggatctcggtggggattggatgtggagcagtgactggatccaggaacccagaagacattatgccaagcgaaatgtgctagacacagtgtagaaaatgaaataagtagaggttcctcttcaaagggactttcctcccagtctaattgagaatagatagtaacctctcttagaagcaaaatttactcaaagacctgtgctaatattcttaaatatctgctagccataatagataaatcaatatactctgtgttcttagctcccacattttagcctagatatttgccctggcatgcctgaattgttccaagcaagcattaggtcacagcctattcctcttccttatttggaagtgtttttgcctctctcagccttccacaagttacttcctctcttcctttgttctcctctgcctttgcctcttttgggaagttctaaggtgctagccaatcaggtcaagcacagaattgggtccgattccagccaatggaaaccagacacagcagtagggtggacgcgtcaggttattattattattattttttttgagacggagtctcgttctttcgcccaggccggagtgcagtggcgctatctcggctcactgcaagctctgcctcctgggttcacgccattctcctgcctcagcctcccgagtagctgggactagaggcacctgccactgcgcccagctaattttttgtatttttagtagagacggggtttcactgcgttagccaggatggtctcgatctcctgacctcgtgatccgcccacctcggcctcccaaagtgctgggattacaggcatgagccaccgcgcccggccagatgcgtcaggttataaatgacccttctcttttgttcatgtgtactctcgtggcaagactgctagtgagcagcaccctttctgcagaaagtaaactagccttgctgagagatcctttgtctcagtgttgatttttgcgacactgagcacccgttcccaacacacacaaagaaacatacttcatgcacttacttacacgtgctaagtacaaacatcaaattcagagtaacaaagtagaagggtggtttccagggctgagggtgtttcctatgcctgtcccaccattgtattttggaagcagataacttctctggcttcacagattcacagctgggcagaaactttgcctcaggatgaaccacaccttgtgtctcacccatatgtgattcagataatatttaggtgatatttgggccttagagttgatactgaaatggattaagacttttcagatgggccaggcaaggtagcttaggcctgtaaccccaacaattcaggaggccgagtctggcagattacttgagctcaggagttcaagaccagcctgggcacatagcaagaaccccgtctctacagaagatataaaaattagccatgcttagtggcacactcctgtagtcccagctacttgggcggctgaagtggcaggatcacttaaggccaaggatttgagaccagcctgggcaacatagtcagaccccatctctacaaaaaattaaattagccaggcatggtggcctgcatgtgtggtcccagctattgggaggctgaggcaggaggatcacttgagcccaggaggtcgagactgtgacaagtcatgattacgccactgcactccagcctgggtgacagagagagaccccatctcaaataaataaataaaagatttttgttctgatgggagtgaagggatcttgcatgtaagaaggacataaagtttaggagtccagaacacagtgtgttatgagcagaaaaatttccacacacaaaaaaaaccctatcttgaagtcctaatacccagtacctcagaatataactgtatttggatatatggcatctacaggagtgatcaagtaaaaataagcttgttaaagtgggttctgatccaatctggctgatttctttataagaagaggagattcagctgggcaaactggcttgcccctgtaatctccacattttaggaggccgaggtgggcagttccagcccagcctgggcaacatggtgagaccctgtttctactaaaaatacaaaaattacctggcaatggtgacccacacctgtactcccagctactgaggaggctgaggtgggagatttgcttgagcctgggaggcagaggttgcagtgagccaagatcacaccactgcactccagcctggaagtcagagtgagactcttgtctcaataaataaacaaatacataaatgaaagataacgccaaggaagcagggagctaacttgccttcttctgttaggtgtttgatgaaaaattgaagcagaaagtttatgagctatgtatgttatctgcgcagaagggctatatggcctaagccagaaagaaaaacagacctacagcttatctgcttcctgtattttgtttatatgtcctggaccatgaagaaaggcagttttttaaaattttgttttgttttgtttttttgaggcagagtctccctctgtcacccaggctggaatgcagtggcatgatctcagctcactgcaaccttcgcctcctgggttcaagcaattctcgagcctcaggctccagagtagcagggactacaagcacccacgaccacgcccaactaatttttttcttttttttgtattttcgtagagacagggtttcaccatgttgcccagggtggtctggagctcctgagctcaggcaatttgaccgccttggcatcccagagtgctaggattacaggcgtgagccaccgcacctggcctagaaaggcagatttatagcttatttgctttatctctttgctttcccctggtcctgccaggctgactccttttctctaattaggtctccacagactataccataaaagtgcatttttctcaccctcctataaaatccctggactcctagttttactacaaataaaccaggattctatttcccagtatgaaaagtttgtcagaaaaaaagaggtagcacgggaccttctttcttttcttcaaaactaattcacctcctcttcttctctttcctgtctctctcttcctagactggcctgcgcagttctagatccccagtgaatccttgggttgacatacaagggacgaagaacctataggaaagggaaatctctagctctcagaggtggctttttggatgtctggatgcattcataaccatcctcgtgttgccagaaaggggtcctgatccagatcctgaaaccgccattgcaaattataactgagaattattacagtgaaagggatccgacctaaccaactccatcttgcttttaacctccaagctgcctttgtccactcctgggtgtaggccaaactagctttgggaggaacttagtttatcttttaaaataagggcattaatagccctttcccaaaacaaatgccctttctgcttgggactagactgcctttataggattaacaagttagtcacaagattagaaactatagtttaggagtcatgcagctagaggctacaagattgtcacctttcccaaattgttcctgggaataacatcagtattttaaaacctaagatcagtgtttgagaaattttgcagtccctgcacttgatggatcacctgacacccagatcaataaactgactcatctggtcttgtgacaccacccaggaactgactcagtgcaaaaggacagtgtcaactctctgatttcatctctgaacaaccagtcatcactctggactcactggcccctacccatcaaattatccttaaaaaccctgatccccaagatttcagggagactcatttgagtaataataaaacttcagtctcctgtacagccagctccacatgaattaaactctttctctattacaatttccctgtcttgaggaattggctctgtctaggcagcagaaaaagagaacctattaggcagttaaacccagaagaaggggttcttggatcttgtgcaagaaagaattaggggggagtccagagagtaaagtgacagcaagttttttaagaaagtaaaggaataaggcagggtgcactggctcacacctgtaatcccagcactttgggaggctgaggtgtgaaaattgcttgaacccaggagtttgagacaagcctgggcaacatggcaaaaccccatctctacaaaaaaaaaaaaaaattagccaagggtggtggcatgcacctgtagtctctgctactcgggaggctgaggtgggaagattgctcaagcctgggaggtggaggttgcagtgacctgagatcacaccactgcactattgcttgggcaacacaaccactctctctcaaaaaaaaaaaaaaaaaaaaaacatatatattagatagatagattcagacagtttttatttcaacactgaatgtttacttttgaaactcctgacgtttaagttgataaaaactcaattttccccatgctaaaaactttatacatgtcctttcttcatgcatacatagaacccttcacacaatataattgttggaagtgtttctgaaatactgtttagacaaattacctatatttttacacctgtactataaaattaatatctaacagacaataaatattaaattatttaatagaagaattatttttcaaaggctaatgatttcacagctgtagcaaaacttttttctttttttttttgagatgaggtctcactctgttgcccaggctgcagtgcagcgatgtaatcacaccccacagcagcctccacctccccaggctcaggcaataccccaacctcagtttttgtatttttagtagagatggggtttcaccatgttgcccaaactagtctaaaactcctaggttcaagcgatctccccacccccacattctaaagtgctggcattgcaggcgtgaaccactgtgcctggccaaaatgtaattttaaaaataatttttaaaatcattatacaatttcctagaaacgatttaatccaatttaaagatttacatttctttccttgtacttcagtgaaaaacttataggattagtaaatcaaggtggtattttcagatttgtatggcaaaaaaatatgcggagacctgacagatgtaaaggatgtattctatcaatatatggagggtcccttacattttaagttcagtgaaagaactggaatgatacaagataatgaactaaaattgtataatgtaaaagcaagagctctgttgctaatgtacagctgtatcagttggatttttaaaaacccaacatactaatttggcagggtgcggtggctcatacctgtaatcccaacactttgcgaggccaaggtggatggatcacttgaagtcaggatttcgagaccagcctgatcaacatggtgaaaccccatctctacaaaaaaatacaaaaattagctggatttggtggcatgcacctgtagtcccagctacttgggaagctgaggtaggagaattacctgagcccaggaggtggaggttgcagtgtgctgagactgtgccactgcactccaacctgggtgacaaagcaagatcctgtctcaaaatattataacatgtgacagtgcagcttccagcagaaataatctgttcctcttttgctcacaccaaatattcacccccacttctaaaaaatataaaagaataagccaaaatgtaacttcaagtcacaagcaaggatctcatgacagtctcatgagacttcttttcattgagagcccagtagagttctcctcactcacaacacttcattgtggaacagaaaaatgaaacctgaataaaccctcccatccagaaaaggaaaataaagaaggtaccccgtagtttctgtttcacagcaaatgtgcaatgttgctgagaagatgagtcagggactgattccacaaggtcaagaatgaacaacagtccttttcatggctacagttctcctgagaatgtttccagtccattgtgatttgttgttcttgacttcacctgatgacatccctaatacagtatcagaaagtatgccttccttgtgcagtaagcacctttctccagctacttctatttatttatttatttatttatttatttatttatttatttatttatttttaagacaggctctgttgcccaggctggagtgcagtggcactatctcggctcactgcaaccttcacctcccagattcaagtgatcctcctgcctcagcctccagagtacccagctacttcattcccacaaaaatttaccatccaaaggattattataaatctatatttagttttgtttttagaaaatactatggactggtagaagtctcaaaatacaacacgactaaaaatacagaaattagccaggcatgacagtgtgcatctgtaatcccagctactctgaaggctgaggcaggagaatcacttgagcccaggagatggaggttgcagtgagctaagattcagctattgcactccagcctgagccacagagagagactctgtctcaaaaataaataaataaatatttttggtaggaaagcttaaagaaaaataattctatatgagaaagaatcttgtatcagaaattttgtcctggaataaaatgactgattgtataagaaagatgaatgttcaggaaaaacaagaaatcccacacatgtcatgaatggtctgtgtaagtcataataagattgatgaaaaaaagttttatgtgatcaaattcactataattaaagggaaattataatggtctttctagagattgggttttgattttaaaaaacaccacttatacactaaagaattggttcaaactacaaaattttgttaagcggtgctttaaataaattatgaaacataatttattcaatgtaaagttcaagttttatggaatctcactgttttcagctttctctcccctcttaaaaggcctgaaatcataactttttcacctaattttcagctcctgtagcctttttttctttgggttctaactgttgtggcctgacactataaaatgttttatttttgaggtctaaaggaaatgtttctttccaaacataatatctcccatagggaacagcagtcacactgtagaagggcttttcttttgcctttggaaaactggcctactaaacagatctcacactttatcaaagtaattcctgtgtcagtattactaagtttggtttggttacaaggaaatttaaattaaatttttttaaattaagtttattatgtccatataactttccgtatatgcttttaggtccctgttccattcagttaaagggctttgactcctgggtctaaaaaggacaccaagtcttgctaaatcttaaacactgacagcagttcaagcctcatcttcagacccagtagaagttcctaatcaaaataaactgtgtttgtgaaacacagggcaagaaattaaaactattcaactcctcaagtaccagtggttatactgaaagaagtggacatgtgagattgtcagggtcaatttttagagctgaaataagtttggtttctctagaaattaactatcaatttcaaaggcaaattgttgcaagaccagcatatgagcccctgcgtcagattaacaaggttgtcttggagcattagcccaccttttttttattctggagatggagtctcactctgttgccgaggctggagtgcaatagtgcgatctgggctcactgcaacctccacctcatgggttcaagtgattctcctgcctcagcctcccaagtagctggggtaacagacatgtgccatgatgcccagctaattttgtatttttagcagagatggggatttaccacgttggttaggctggtctcaaactcctgacctcaggtgattcacccacctcggcatcccaaagtgctgggattacaggcatgagccaccgtgcccagcctagcccactatttaataaagattatatagtgtataaaaaggctcatggaaattatacttacaggcaagatgattaaaattttatagtttgtttataaaatattgaaaaaccaatttaattggccttgtgccatttttactagggaatattgtttgggaaattaagtcttttctctcaaaaaataaaggttgccacctttttttgaaatctttgcgataccactttggttaaatgaatcacttattttataatggcctgtgatcctattttatgatatcaagtgttttaaactttttatatttgacaagctttccaaagtcacattttaacttgcgtcgtcattaaacttttgttaatcccctgaaatccagaagagacatatttggcttatttggtataaaaatcatacaggaagcattgtcaaatacaaaatggtgtttggctttctgtgggctgtacttgtataaatatgaaattggcatgtattccaaaattatggaaaactcttataattctgatatgacttactatatgttattattttattttttgagatggaatctcactctgtcacccaggctggagtgcagtggcaccatcttggctcactgcaacctctgcatcctgggttcaagcaattcccctgcattagcctcgcaagtacctgagactataggtgtgcaccatcacacctggttaatgtttgtatttttagtagagatgcggtttcaccatgttggtcaggctggtcttgaactcctgacctcaacccacctcagcctcacaaagtgctgcaattacagatgtgagtgactgtgcccagccacatgttattaataattataattgttggctgggcatggtggctcaaacctataatcccaaaactttgggaggccaaggcaggcggatcacctgaggtcaggagttcaagaccagcctgaccaacatggagaaaccccatctctactaaaaatacaaaattagtcgggtgtagtggcgcatgcctgtagtcccagctactcagaaggctgaggcaggagaatcgcttgaaccccagaggagaggttgtggtgagcccagattgtgccactgcactccagcctgggcaacaagagcaaaactctgtctcaaaaaataataataattattattattattgactattatgtaaaatggtggtatgtcacagaagtaaccaaaatttccattatagtcaattgtggttttaataacagctgtcctgagacattttgttgccacaggcaattgttgtcttgtttggatcctcttcaaaagttggtttataatcagctacaggaatttgataggtgctctggaatgcaagtttctgataactttggaaaatgtgacattagaatagaggaatagaggaaagaactttcaaaactttcatggataactaaaatgttcatgaatatcaaacacaacacacattaactgcatggactgaactaataggagtctaaagtaatctttctgattttttcttttgatcctttgttttgttttgcagagtcaaggaaacttttcttttgagctattgacagcaattttttttttttttgagacagttgcccaggctggagtgcaatggcatgatctgggttcactgcagcccctgcctcccagcctcccaggttcaagcgattctcctgcctcagcctcccaagtagctgggattacaggcacccaccatcatgcccaggtaatttttgtagagacggggtttcaccatgttggccaggctgatctcgaactcctgacctaaggtgatccgcccaccttgcctcccaaagtgctgggattataggcatgagccaccgtgcccagccgacagcatttaacaattgaggaaagtatactgctgtgaagaaaatttggaacatatttgtttctctctacctgctttctccagaatttggaaactatttctgagtattcttttttttttttttttttttttttgagatggagtctcactctgttgccaggctggaatgcagtggcacgatcttggctcactgcaacctctgcctcccgaggtcaagcgattctcctgcctcagcctcctgagtagctgggactacaggcatgtgccaacacacccagctaatttttgtatttttagtagagacggggtttcaccatgttggccaggatggtcttgatctcttgacctcgtgatctgcctgcctcagcctcccaaagtgctgggattacaggcgtgagccatggcgcccagcttacgtttttcaatttttatgattttccacagtttggactgaattctaattttttccagctacatgtctctgaaataatgttttcaattttttcttctttcttttcttttttcccccatattttctaatttgaaatcactgaaaactaaactgtattttcttgaagccctgataactgaagctagacaacttaaacttcagaagaaaataacagcaacctattcacatacataagccactttcatacctatctactgatgtatggacttcagagtaatatggcctgtatctattttccaggattattctttgtttttcttccttcctcctgctattttctcttcataggacacgacactttacaaactgctaaaaatgagctttccaaataacatgggacttgcccacctgaaaataaactgtcctagccatgaaggatcagatgaaacctgatttttttttttttgagacggagtctcgttctgtccccaggctggagtgcagtaacgtaatctgggctcactgcaacctctgccttgcaggttcaagtgattctcctgcctcagcctcctgagtagctgggactacaggcatgtgccactacgcctggctaatttttgtatttttagtagagatggggtttcaccacgttggccaggatggtctccatctcttgacctcgtgatccgcccgccttggcctcccaaaatgctgagattacaggcgtgagccaccgcacccagcctctcccaaagatttttaaaggagaaaaggggaaatgtgaaaggaaaataaatcttggcacccaacactcactaagccaaagggaaaagtcaagctgggaactgcttagggcaaacatgcttcccattctattcaaatcatccctctgctcactgagataaatgtgtgtgattgcttcctttgaaaatgcttaccagaaacccaaaagaatgcaacctttgtcttttatctacccgatgacctggaagcaccctccctgcttggacttaccctgcctttccaaaccaaaccaatgtgcatcttacacattaactgatatctcctaaaagtgtataaaaccaagctgcgccccaaccaccttgggtatatgtggccaggacctcttgaggctgtgtcacaggcaagcatccttaactttggcaaataaacttgcaaaattgactggaacaaaagaagtaatcttcagagaaaataaaaataacagggaaaaacagggagattacatgataaaaatgtcaacttacaaagatgatttcagaaccatcagtgtgtatgcactaaaaaacagctgcaaaacgtgaagcaataagtgacagaagtgaaagaaatacacaaatttagactgagcaaagaggattattagggtagtcaaagtactctgtatgttaccataatatgtgaatatgtgccattttacagttgtccaaacccacacaatgtacaagtgtgagccaactataaactagggatgttggatgataatctaccactttggtggaggatgttgacaatggggaaggctatgcatatgtgggggaaggagctatatgagaaatctctgtaccttccactgaattttgctgggaaccaaaaattgctctacaaagtaaagtatatcatagaaaaaaaattgaattagaaaataggttaaaaatatgagaaatttcaccgatgcagatgcacaaataggcaaacgaaaagattttccatattactgtccatcaagtctcagaaattaacaatgttctatttctttattgtaattgaaaactgaacagcaaatgaatttttatggtttgttttctccaacaaacttaataatattaaaatatgtgagaaataatatttattgcaacaggttatgagggtggaaacaaacagtctcacaatttgctagaagcataacagagcttactgacattttcaaggaaaaacaacaaagaaagaagtcatcaaacaagatggtatcttgacaaaggcacagagctccacaactgcttcatactctgcacacaataaatcctctcagagagatgaaaggagtgatgacaaatgggcttgcatttgagctgtggacactatcactggtattattcatataaccagggctctatatcacccctctggagaagaaagtgcaacacaaagtctgtgtaacaaaggaaagcaaaagtagcaataaaggtccagagaaatacacacatgcaaatacagtactgcaaactcagtaaaaggagtttttgactggagtgtgaactttcaacttgaagatacatttcgcagggacattcacccaaagcttgagagctagagcagagagacttgcttgcagtcagtaactgagtagatgaaatgcgtaatttttcactaggtgataattccctttgggaagaagtgccttatctttaattattccactttttgttatatggttcatgcttttgaactgcagttgtctgaaacttgcttgctattgaattgtgtaacaccagataatagcaggttgtcaaaagataaccccagtggataatttaagctgcttttatgagaagcctggtgctaagctgccttacacagtctttttacagtaaccataaaaaaaactgagtttatttgatcatgtattatcccttttcatataaggtcatattagaggaattcttggaagaggttttcaaactagtcctttgggcatttaaaaaatcattatataaacgtacacttcttcaatacataagaacaaacatttttcctttacaaaaaaacctcatttttaggccaaaataaattacaacttgctgaaataccttttatggctcagtgctcattccagctatataaaattatattttttgcacatcttcagaaattagagatactgagagagagtggttactttttttaggggggcggtgatggaatttcactctgtctcccaggttagagtgcagtggcgcaatatcggctcactacaacctccacccacagcgttcaaatgattctcctgcctcagcctcccaagtagctgggattacaggcacctgacaccatgcccggctaatttttgtatttttagtaaagatgtggtctcaccatattggtcaggctggtctcaaacttgacctcaggtgatccacctacctcggcctcccaaagtgctgggattacaggcgtgagccactgcacccggccagagagagagtggttacttctaaaatgacatgatgatataaccctggcttagggaacagatcaagttctaaatctcaggaataaaagatactcattatccaagccatatagtcttgtactatatacatattaacagtctatgcaatgaaaaatgaagaacagaaatttcataaaactttaaaaacacacaacataggcagggtgtggtagctcatgcctgtaatcccagcactttgggaggtcgaggcgagcagatcatctgaggttgggagtttgagaccagcctgaccaacagggagaaaccccatctctactaaaaatacaaaattagctgggtgtggtggtgcatgcctgtaatcccagccacttgggaggctgaggcagaagaatcgcttgaacccaggaggcagaggttgtggtgagccgagatcgcgccattgcactccagtctgggcaacaagaacaaaactctgtctcaaaaacaacagcaacaacaacaacaaaaaagacaaaataacacaacataaaaatgtaaagaaaacatttcatgtacaagctactccatttggcaacgtgtactaagataaaaacttatctacaaacagaatataacacaaagaaaatgtgatttaaggagtgatctcaggtccacagctcttcagttcttccaaatttgtagatcagagtggttgggtaacatatgcaccaaaaagaatccacatggaagcaataagtaccccaaacatcaacatgaaaccaacgaaaagccaaactcaaggacctgttcttcctaaacagccactttcatagctatcacctctcacctgagcattggatacagcatttatcatgaagaaagccaatgtgggaaatacaccacatgtgtgaaaggcatggttcaactgttctggcctacaatacaccactgctgcgtcattatccaccagcctgtaaaaaacaatatacctgtcacaacagacgccacaacatttcttctctcactcgtcaatacattcacattctggccattgaaaattatctaggaagactgccattttctacttcttaagcataaatttttcattaaatgctgtatccccacttcctcaaacacccacgcggacttcaggcatgtgcacaaggaagactgctgctccgcagtctggccggcatcctccagctccacctcagccttgggagcccacaatgttctatttttatttgatcccatctgcttccagcaatcactgaaaagaaacagcctttaccaaacactccaaaatgtctttgtggtgacgtcattaggaactcataactgtccccaggaattcgcagtgggaacaaaggttttcaggaatattctcagctcaccaagcttgcacattatcaatattggtgaattgacaaattgcagttttttgcaaagctgctatctcagaatcacaaacttacatctcacaatcagctggctccctccccccaagacattggtacagtcatcccacattagctgctgttttgctttccatgatttcaattaccagtggcaactgtggcccaaaaacattaaatggaatattcccaaaataaataactcggaaattttaaactgtacactgttctcactaatgtgatgaaatttcacattgttccacccaggacataaatcatccctttatacggtgtagccacacagaataacctacccctctctcagtcacttagtagtcatctcagttagcgttgttagagtatcatcgtgtttgtgttcaagtatctcctattttacttaattatggccccaaagcacaaaagtagtgaggcttgcaacttggatatctcagagaagctgtaagctagacacaatagcatgtacctgtagtctcaggtagtctggaggctgaggtgggaggaccactttttgacgctgcagtgtgctaagatcttacctgtgaataaccactgcactcagcctgggtgacatagcaaaaccccctaacaaaaaaaaaaaaaaaaaaaaaaaaaaaagagaaagcaagaaagctgtaaagcgcctcctttaagttaaaaagtgaaaggttattgatttaataagaaaaaaatacagatgaagatgctaagatttatcataaatcttctgtacaagtgtgaataaaaataatcagtactagctttgctgtcacacctcaaaacttgactgaaactatatatttatggttgggtactatccactttcaggtatccactagaggacacttggaaggcatcttgtgggttaaagggggactatggtatgggcaaaaatctatgttgtttgatttcgccatagaaaacaattgtcgcacattattttaaccagcagagtgtaatgcagtgtctgttagaagttctttactaaggtgggataaatctgtgttggtgaaaggaacgtcactgagttacgaaaacgaataacattttattaattgaaccatgagacttctgatacattttgaatgtaacagcagtaaaatatagagtaaatacttcaatgtgaatctggcctgtgaccatgctattctgattcttttgattaaattctcctctctgataactgctgtcttccacttccaagaataagactaattttacatttatctttgctatataacagctgtcattcaatggagatgatcatcatttcctctgcattatttctcccacacaatccatccctagtaacctatcacttgcctctcatgaatacccttaatattccatcaatgtcctcactggtatttcagtcagttggttgtgcaattattttctacaacccaaagtggcactctacgtgttcatggacacctggaacacaagcacaacttacatcataaacttacattattctcccagttactccatggtgtgtaactcacagaatattgaattttaaaattcagtgaccttaatcttcaggaagcatggaaatgaaggagccacactgaatgaaggaggctctctcatcttgttgattcattcccagataccacaatgaaggatatgtaaggaagatgatagacttcaaaccttaggataaacgtcatagtctagtagctattttaagaaacgccccattggccaggtgtggtggctcatgcctgtaatctcagcaacgtgtgaggccaaggtggcaaatcacttgaggccaggagcttgagatcagcctggcaaacatggtaaaacaccatctctacaaaaaaatataaaaattatctggacatggtggcatgactgtaatcccagctacttgggaggctgaggcacaaattgcttgaaaccaggatgtggaagttacagtgaggtgaactggtgccactgcactacagcatggggaacagagcaagactgtcacaaaagaaaaaaaacagaaacctcaaatttaatgtaatattttataaactgaatgagccattttcacacatgcacttgctcctttaaaatacatactgtcctgagttttaacaaatgttgtctggtagttattctgtaataatattccaggccaatcttggagaagcagatttggttatccctagtatgatttcaaagatgtgtagtctgtttaaaaaactggttgaaatttgtgccacattgattacatttccaagttttctctcaagtagggataatttggtaaaggctgaagacacactactgcttccaggtcctttc

SEQ ID NO: 141 - DNA, 10071 bp, Homo sapiens
  source 1..10071: mol_type = genomic DNA
ctgaaaaaggcctcagagatgttctccctcagtgtttcctaggcatgccgcgagaaccagccacatcaaaatgcagattcctgttgcctaagacctgctgattcagaatcacgggttgagggtcttggattccccattggccacaagtgtctcgagagactcttacgcacagtaacatgagaactgccgatcttgcctgatgcccttgttttacagatggagatggaggcccaggggcatatcgattctccagcatcacacagacagaaagagcaaagctagacatctgtctccttgggaacgctgagctgcctctcagtagactaaacggatgcagtccggggaagaacgctcggcaaatggttatgcattgtcaatgctgggagagatttaggcggaagagggagaaaagtgggactttacttttgattctatatttgtacattatttccatttcttaaaataactatgtaacacttccatttagatataattatacaatatgacaagtaagtaaattgatacttttttctttcttttctttttttgagatggagtctcgcttttgtcatccaggctggagtgcagtggcgtgatctcggctcactgcaacctccgcctcccgggttcaagtgattctcctgcctcagcctcccaagtagctgggattacaggcgtgtgccactacgcctggctaatatatatatatatatatatatatatatatatatatatatatatatatgtgtgtgtgtgtgtgtgtgtgtgtgtatatacatatgtgtatatatatgtatacatatgtgtatatatgtgtgtatgtatacgtatatatatgtatgtatacgtatatatatgcgtatatatgtatgtatacgtatatacgcatatatatgtatgtatacgtatatacgcgtatatatgtatgtatacgtatatatatacacatgtatacatatatgtatgtatacatatatatacacacacacacacgtatatatatatgtatgtatgtatattaagacggagttttgctcttcttgtccaggctggagtgcagtggcgggatcttggctcaccacaacctccgtctcctgggtggtggagaaaagggaaagagaaaaagagaggagagggagagaaaagaaaagaaaggaaggagggaaggaaagggaaaagaagggaaaagaaggaaggaaggagggaagaaaggctacaaacaagtgtctttggttttttcagtcattaaagactttgttttttacagagatgtttcccagcacactactactggcacacctcattaacgacgagtcattaagctttgcagaagtgactgtgtatatccagttattggcagggcttgcttactcattcagcaaatgttcaccaaagtttgctcggttcctagccccagccagacactggaatcgcagagaatcacacaggggagtcaagactctttctgcctttgaaggcgtccatgtcacagtagagaaaacaggtgagaaattacattaaaaaccacagctcaagcagggtgcagtggctcacgcctgtaattccagcattttgggaggccgaggtggatggatcacctgaggttaggagttcgagaccagcctgaccaacacggtgaaaccccgtctctactaaaaatacaaaaattagctgggtgtggtggcacgcacctgtagtcccagctactcaggaggctgaggcaggagaatcactggaacccgggaggcggagcttgcactgagccaagattgtgccactgcactccagcctgggcgacagagtgagactctgtctcagaaacaaaacaaaacaaaaaaccacagctcaaatggggctctgtggtgcacacctgtagttccagctgttcaagaggctgaggcaggcggatcacttcagcccaggagtttgagtctagcctgggcaacatagtgagaccctatctctaaaaaataaattattttttttttttttgagacggagtcttgcactgtcacccaggctggagtgcagtggcacaatctcagctcaccgcaagctctgcctcccaggttcacgccattctcctgcctcagcctcctgagtagctgggactacaggcgcccatcactgcgcccagctaattttttgtaaaaaataaaaatatttttaaaaaaacaattccacagctcaagtgccatctctgccacttcagcaatagcctatatttgctgagcacttgctacctgctctgaattgtgttaagcactttgcatgtattatctcttgagcttatgcctgagtataaatcatattttttcttttttttttttttttttttttgagacagagtcttactctgtcacccaggctggagtgcagtggcttaatcttcgctcactgcaacctccaccgcctgggttcaagtgattctcctgtctcagcctctagattagcagggattactggcgcccgccaccacacccggctaatttttttgtatttttagtagagacagggtttcaccatgttggccaggctggtctcgaactcctgacctcaggtgatccatccacctcaatctcccaaagtgctgggattacaggcgtgagccaccgcacccagctcattgtgattattttatgagatagaagatataataaaagaaatcatgttggctgggcacggtggctcacacctgtaatcacagcactttgggaggccgagacggctggatcatgaggtcaggagatcgagaccatcctggctaacatagggaaaccccgtctctattaaaaatacaaaaaattagccaggcatggtggcgggcacctgcagtcccagctactcgggaggctgaggcaggagaatggcgtgaacccaggaggtagagcttgcagtgagctgagattgcgccactgcactccagcctgggcgacagagcaagactctgtttcaacaacaacaacaaaaagaaatccaagagtgctaaggaggcacagaagtggggtttctgagccagccagagtggtgggagcgaggaatcagaaggagtgggggaagaggagtaaatactttactttagagaaggtagtggcttcaaggtttcagtaagtaatacttttccaggcaaagaagatggagaatattccaggcagaacacagcatgaacaaagaccaaagggatgaaattagaattctgtacacagtcataaaaaagaacaaaatcatgttctttgcagtaacatggacgcagctggaggccattatccaaagcaaactaatgcaggaatagaaaaccaaagactgcatgttctcacttataagtggaagctaaacattgggttctcatggacagaaagatgggaagaagagacactggggactcgtggcggggagaaatctcaccattgggtactattactatgttcaagtacctgcatgataggatcaatcttactctgaatctcagcatcactcaatatacccatgtaacaaacctgcacatgtaccccttgaatctaaaagttgaaatttttatatagatatagatgtgtgtgtacgtaaattagaattccagatctcccaggctcagggattagtatgaaagaaaagggaattggtggccaggcagtggtcattcatgcctgtaatcccagcactttgggaggctaaggtggaagctcgcttgagcccaggagttcaagaccagcccgggcaacataaggacacctcatcttggccgggcacagtggcttatgcccgtaatcccagcactttgggaggctgaggtgggtggatcacgaggtcagaagttcaagaccagcctggccaagatagtgaaaccccgtctctacaaaaaatacaaatacaaaaaattagccaggcatggtggcaggtacctgtaatctcagctactcgggatgctgaggcagaaaattgcttgaacctgggagacggaggttgcagtgagcggagattgcgccactgcactccagcctgggcaacagagcgagactcagtcttaaaaaaaaaaaaaaaaaaggatacctcatctctttcttaatttatttttgagatggggtttcactctgttacccagcctggagtacagtggtgcaatctcaactcactgcaatctccacctctcaggttcaagcgattctcctgcctcagcctcccatgtagctgggactataagcgtgtgccaccacgcctggctaatttttgtatttttagtagagacagggttttgctatgttggccagactgatctcgaattcctgacctcaggtgacccacccgccttggcctcccaaagtgctgggattataggtgtgagccactgcacctggctacctcatctcttaaaatatatatacacacacacatatacacacacatatatatacacatatatacacatatatatacgtgtgtgtatatatatataaattccagatctcccaggctcagggattttatatatatgtattttaaatatttattttaataatatatgtattaaatatttaatatataatatttattatttatatatatttatataatataccatatttatataatatagtatatttatataataaatatatactatatttatatataatatataccatatttaatatatatttaataatataattatatacatattttaaatatatatttaaaatatatgttttaaatatatatatttaaaatatatgttttaaatatatattttaaatatatatttaaaatatatattttaaaatatatttatttaaaatatatatttaaaacatatattttaaatatatatattttaaaaaaatatattttaaatatttgaggcaaggtctcgttctgtcacctaggctggggtgcagtggcaggatcatagctcaccgcagcctcgaccttctggtctcaagtgatcctcccacctcagcctcctgagaagctgggatcacagacgtataccaccacacctggctaattttttttatttttggtagagacagagcctcactatgttgtccagactggtcttgaactcctcacctcaagtgatctgccctcttcagcctcccaaagtgctgagattacaggtatgagtcactggacccggctggcattctagccttgcctgtcccgccacctccttacccctcaccaggtcctctctctgtcctctctcccacaggtccttcctgtttatccgctcaaaggtgctgagagccaacctccaggcctcctctggcccgaagtgggtgatgagcagctgggccatttccaggggaccggccttctccatgcttccccaggggatcttgccttctcccagctctgtcgcggtccccaggtataacttgaacttcttcagttccacagcctcgagttcttccaagtaggtggacaggcgacagaggccgtccctgcctgcggttcgtagcatgggggtgccgtgagccccaaaggagaggacctggaggctgagatgctcctatgcacgggacacagggcgaccccagcacaccttccattgcatcattcacaggcagcgggcggagaggctgagccagtggttggaggagagagcaagggaggaaagaccttttgctgaaataatgctttctcactcttcagttccctcctgccctgccccactcaccaatggctgttctgggtggagaagaggaagttcggggggagattaagaaatccgaggagccacttggctgatgaaaaagattttcacttctgctgtctcttcctggatctcttgacaaaacagtcactctctttccgctttcctcttgttttcctcatttcactagtgtgtgtggtagagtgtattatcaaaactgcgactgcgcctcttccagggagaatttttttttttttgagacagagtcttactctgtggccctggctctgcgatcttggctcaccgcaacctctgcctcccaggttcaagcgattctcccacctcagcttcccttgagtagctgggattacaggcgccggacaccacacccagctaatttttgtggttttagaagagacagggtttcaccatgttggtcaggctggtctcgaactcctgacctcaggtgatccacccgcctcagccttccaaagtgctaggattacaggtgtgagccaccgtccctggcttttttttttttttttttctttgagtcagagtctcactctgccacccaggctagagttcactggcgtgatctcagctcactgcaacctccgcctcccaggttccagcgattctcccacctcagcctctcaagtagctgggaccacagacatgcgccaccatgcccagctaagtttttgtagttttggtagagacaaggtcttcttatgttgcccaggctggccttgaactcctgagctcaaacgatccgcccacctcagccttccaaagtgctgggattacaggcatgagccactgagcccagcctcagggagaattattaaggacctcacgtaggtctgctattttttttctgttctctcagtcacaagagtggcatgagagggactttgcggtaggcaggatgatggtccccaaagatattcatgtcctaatggccagaacctgtgacatttcaccctacatagcaaaagagacttagcatatgtgaccaaatgaaggcacttcagatggggacattatcctggttatctgggcaggacccatggaatcacaagagtcttttttttgagacagagtcttgctctgttgcccaggctggagtgcagtggcacgaactcggatcactgcaagctccgcctcccaggttcacaccattctcctgcctcagccttccgtatagctgggactacaggtgcccgccaacacgcctggctaattctcttttttttgtatttttagtagagatggggtttcaccatgttagccaggatggtcttgatctcctgacttcgtgatccacctgcctcagcctcccaaagtgctgggattacaggcgtgagccaccgcacccagccacaagagtctttataagaagaagacaggagggttagtgtaagaggaagatgtgactgggtgcaatggctcatgcctgtaatcctagcacttggggaggccaaggcaggtagatcacctgaggccaggagtttcacaccagactggtcaacacagtgaggccccatctctacaaaatatgtgttagcagaatttatgaattctgatggaagagcaagtttataattccctctgtctcctgcatcatgccaactttgtttcatgctcctaatcaattaagacccctcagacacacacacacacacacacacacacacacacacacacacacacacacaaaagccttcatagccaggcgcagtggctcacacctgtaatcccagcactttgggagactgaggcgggcagatcacctgaggtcaggagtttgagaccagcctggccaacatggtgaaaccccgtctctactaaaaatacaaaaattagccgggcttggtggcacgcacctgtaatcccagctacttgggaggctgaggcaggagaatcacttgaacccgggaagcagaggttgcagtgagccgagactgcgccactgcactccagcctgggcaacagagcgagactctgtctcaaaaaaagaaaaaaaaaattagctggggtttggtggcgggtgcctgtagtcccagctactcaggaggctggggcaggaaaatcacttgaactcaggaggcggaggttgcaatgagccaagatcccgccattgcactccagcctgggtgacagagtaagactccgtctcaaaacaaaacaaaaaaaaccttcacagctttttatgagacattctcccacatccagtcccttccaggactaatattctgttgcatggcatgcagcagttttgagcaggggagggatggagtcaggtctgggttaaggaagattcctcaaggcccttgtggaaggcagaccaaacagaggaggcctggattgggagagcgagaagctgaagccttcatgtttcaggagatggagataatgcctgagtaagggcaggcggtgggtgcatcctgggagtgtggggatggcagtgatcattagaggggaggagaaaggtttggcaaacctgaactacctacagaccccatctgagcttcctcaagtggctcacgacgcaggctccttccacgccactgctgcaggtggtggtaaaactaatttctaggaattcggaagcgaggcttgggggaagctgaatccacatctgtctacttcatgcttccactttcaagatagaactttctcatggggaaagaagagaattggcaacttctatagctgcttctgggcttagtgccatttctggaaacacaagaatgaatctaaagacaaggaatgccattttcctttttttttctttttttttttttgtttttagtagatggggtttcaccatgttgcccaggatggccttcaactcctgagctcaagcgatcctcccacctcggcctcccaaagtgctgggattacaggcatgagacaccgcacccagcccaattttccttttttaaaaaatttttttgctgggtgcagtggctcacgcctgtaatcccagcattttgggaggctgaggcgggtggatcatttgaggtcaggagttcaagaccagcctggccaacatggtgaaaccccatctctactaaaaatacaaaaataacctgggtatggtggtgggcacctgtaatcccagctacttgggaggctgaggcagaagaatcacttgaacccaggagtggaggttgcagtgagccgagatcacatcactgcattccaggctgggtaacagagacaccatctcaaataaataaataaataaataaataaataatagaagttgtcaccaccacctgcttgccactcccttgaattctttcctgtgtgaagccaagaactatcccggggtaagccctgttttggggcctcacttgcctagcatcacaaggataaacccattcaaagcaggtgctaatttgccctgttggttttcaactagaagagaaattattatcatcagggacatttataaaaattatatatagaaggctgggtgtggtggctcacgcctgtagtcccagcactttcggaggccaaggtgggcagatcacttgaggtcaggagtttgagaccagcccggccaacatggcgaaaccccgtctctactaaaaatacaaaaattagccggatgtgctatcgcgcacctgtaattccagctactcggggggctgaggcacgagaatcacttgaaccttggaggtggaggttgcagtgagccgagatcacgccactgcactccagcctgggtgactgagtgagactctgtctcaacaacaacaacaaattaaaaataaaaaaataaataaaaatacaaaaattatccaggcatggtggcgtgtgcctgtaatcccagctactcgggaggctgtggcaggacaatctcctgaacctgggaggcggaggttgcagtaagccgagatcacaccactgcactccagcctgggccacagagtgagactccgtctcaaaaaaaaaaattatatatagatgaaatattttatatacattacaataagaattataaatatataaatatgtatatgaaattggtccctctctagacttcctgaatcaggatcttggtggggcaggggccatcaaacatatgtttctttttcctttttttcttatattaattttttgaatagagatgaggtctcactatgttgcccaagctggtctggaacacctgagctcaagtgatcctcccacctcagcctcccaaagtgctgggattacaagtgtgaaccaccacgcctggctaaatacatgtttttataatataaagctcccctagtgattctgctgagaaacatttctctgtgttagtactagaaaggcacagagaaatgcttgtttttctatcagcagaatttcccttttgccattccggaagagacctgtttcctttgagggaatacttt

SEQ ID NO: 142 - DNA, 2553 bp, Homo sapiens
  source 1..2553: mol_type = genomic DNA
atagaggtgaagaaatcaggaaacagtagatgatatgccagagaacataattgggaaatggcaaataatcgcgaggcttttagggctaaagtgtgggtgcagaaattcttaagactacaagaacgagttatggggaatacaatttgaaatcaatatcaaagtgatgagcaccttgttggagtatcattgatcaagagcctcagaaagagggtaaatcagaggtgaaacattaagtattcagttactcatcatgccccaagcccaggctaagtcattggtgtggacccacggctacttctacactacactgatgactgtaaagtctctccagggatttcccatgatatggcaggactgacctactggaagcaactgtggtcagttgagaggtattgtttagtgactaataaatgaatggatgaatggatggatggatggatggatggatggatagatggataggtgggtgggggtgagtgaatgggtgaaagggtggatgagtggatgaatgggtggaaggatggacaaatgagtggctgggtaaatagatgggtaggtaggtagatagatggatgaaggggtgggtggacagatgaatggaagggttggtggttggatggattaatggatagatgaatggatggatggatggatggatggatggatggatgagttgatggatagatggataagtgagtggatggatgggtgaatgagtgggtaggagggtggatgggttggtaggtgggtagatgggtgggtgggttgatagatgggtgggtagattgatagatggatgggtgagtagataaatgggtagatgaaagtgatgcaaaattattctttatccctcttccttgggatctcaagtcatgtatgttacaatcctcccacgtgcatcttctcactgtggtcctcatcatttttttttcagttacctgcaccgtgcctcccatacttttccacacaatgggatctcttagccccacaatccattatttgccattcctacatccctcatagagcactggacactctttctggctttccttctctggcataatgaaatataaattttcatttatgtctgaatagcaactgtgaagctcattgtttttgtgacaccggggaggtcacctaatctctatgagcaaaaagaagttagtaacacaaccaccctcataggaagtgaagactgaatgagttagtggaggcaagttacctgtcgtggagacaggaacatagaaaatgctggatacatgtcaaatgccagtgttatcactctatcctcacctgtcacccagatctccagcttgttgctggggaaggaggccaagtgtgatgagttgctcaggtaatacacacagctgtagtttccactgtcattacttgtcacgttccagagcatgaaatcagtctggttttttcttacttgcctgacttgtaatggttctgggatccccattttcaacagagcaattacaatacattcggttccattgtatggagtgagacatcgaagtgtcctgagacctggagtcatcccagggtctacattgactgagagcaaaggttctgggagtgatcctgaagaggacaaggcaatggaggtaaagagaagggccagggcttttccattttctactgcacttggggactatctcatccatctctccgtattaaccatgtctttcatcttctgcatttgatgctttaacatcttggggccttgctgcccttggtgggacctcccctcgcagggttagttaatttctagagccagtaaacaacttgtcctcaaggatgtccctcaaatgcaagccaatagatccagagcccatactctcaaccaccttaattatggggctctcacactcaaggtcaatgttgtcctctcctaatcaccccaggtccaagaactagacaaccagggacagcctctacaccccaaagccaattctttttttgtttttcttttctttctttcttttcttttcttttctttttttttttttttttttttttttgagacaggttctcattctatcacccaggcttgagtgcagtggcacgatcttggctcaccgcagcctctgcctctggggttcaagcaattctcgtgcctcagcctcccgagtagctgaaagcacaggtgcacaccaccacacccaggtaattattgtatttttgtagagatggagtttcgccatgttacccaggctgatgtcaaactcctgacctcaggtgatccaccctcctaggcctcccaaagtgctaggattacaggcatgaaccaccacacctggccaactctaatcttgttctccccacaaaatacaatcaaagctctggtccacagttcttcctcctccctctgcccctcattgaccctggtgcttccccacatactccccccagtatagccttcctcctcctcttgggaactgtaacagaccatcttttccatggcaatcatcacttggtctgtcagtcttaccataccccaattttctattaactgaccatattctacaccaccctcccacatccaca

SEQ ID NO: 143 - DNA, 1090 bp, Homo sapiens
  source 1..1090: mol_type = genomic DNA
attttcaacagagcaattacaatacattcggttccattgtatggagtgagacatcgaagtgtcctgagacctggagtcatcccagggtctacattgactgagagcaaaggttctgggagtgatcctgaagaggacaaggcaatggaggtaaagagaagggccagggcttttccattttctactgcacttggggactatctcatccatctctccgtattaaccatgtctttcatcttctgcatttgatgctttaacatcttggggccttgctgcccttggtgggacctcccctcgcagggttagttaatttctagagccagtaaacaacttgtcctcaaggatgtccctcaaatgcaagccaatagatccagagcccatactctcaaccaccttaattatggggctctcacactcaaggtcaatgttgtcctctcctaatcaccccaggtccaagaactagacaaccagggacagcctctacaccccaaagccaattctttttttgtttttcttttctttctttcttttcttttcttttctttttttttttttttttttttttttgagacaggttctcattctatcacccaggcttgagtgcagtggcacgatcttggctcaccgcagcctctgcctctggggttcaagcaattctcgtgcctcagcctcccgagtagctgaaagcacaggtgcacaccaccacacccaggtaattattgtatttttgtagagatggagtttcgccatgttacccaggctgatgtcaaactcctgacctcaggtgatccaccctcctaggcctcccaaagtgctaggattacaggcatgaaccaccacacctggccaactctaatcttgttctccccacaaaatacaatcaaagctctggtccacagttcttcctcctccctctgcccctcattgaccctggtgcttccccacatactccccccagtatagccttcctcctcctcttgggaactgtaacagaccatcttttccatggcaatcatcacttggtctgtcagtcttaccataccccaattttctattaactgaccatattctacaccaccctcccacatccaca

SEQ ID NO: 144 - DNA, 110074 bp, Homo sapiens
  source 1..110074: mol_type = genomic DNA
tggatttttaaaaatcaaacaaaaaataacaaaagattagtggatatttgaacaaagcctctaaaaatcaaggacagaaactgtgaggtattgctaggatagccccagtttcttctaccaggaggttgaattaataatttcaccacagccgggcagagtggctgatgcctgtaatcccagcactttgggaggtcgaggcaggcagatgacttgaggtcaggagtttgagaccagcctgggaacatggcgaaaccccgtctctactaaaaaaaaaaacaacaaaatttagccgggcgtggtggcgtgcacctgtaatcccagctacctggtgaggctgaggcatgagaatcccttgaacatgggaggcagaggttgtagtgagcagctgagatcacgccactgcactccagcctgggtgacaaagtgagactctgtctcaaaataataataataatttcaccaccactgagatgatctcgtgacatgttttgtccaacaaaatgaggcagaagtgacattatacagttctgatcctgggtctcaggaggcctggggtttctgctgtgttgcagaaccctgcccagccatcctgagaacagcccaatctggcctgcctgatggaggataagaaaccacatgaagcagagccaagtaataccagctgagtcctaaaagctccgccagccccaactaaccaccagctgcctttctacaagtgaatgatcccaagcaaagtcagcagagcccaatataaatcagcagaacaaatcaaccaaccaaccaactggtagacttgtgactaaaaacagatgatacttttatatgtcactaagactttgtagttgtttattaggcagcgtcattgtgccagtagataaccaatacaggaatcaaaactttaaaaacaggaaaagaagcttccttccagttttcaatcggacatatgaggaacttggaagtcatgactccatcttaataagttaaaaaaaccgaacaaactaaaaatcagcaactcttggctggttgcagtgggtcatgcctgtaatcccagcactttgggaggctgaggtgggaagattgcttgagctcaggcgttcgagaccagcctgggaaacatggggagacccccgtctctacaaaaataaaaaataaaaataagctgggtgtggtgacgtctgcctgtagtcccagctacttaggaggctgaagtgggaagattgcttgagtctgagggggtcaaacctgcaataagccaagattgactgggtgacagagtgagactgtctcaaaaaaaaaaaaaacttcttagatctgtcacagaattgaggtcacagggcaaaccactgcctccaaaattggagagacagacagatcgtacagagaatcacaacttatcactgcagagtcacaggtgcagagaccttgctaggaacaagtacagggacaggaaagcctgaactgcaatttacaaattgctggaggctcagtgtggacaagtctaagagtttaaaactccggggatggggccagtcttgaagggcatgcccatacttttggtttcttgggggtttttttgtttgtttgttttgagacagggtctccccctgttacccaggctggagtgcagtggcacaatctcggctcactgcaacctccacctcccaggttcaagcgatcctctcatctcaacctcctgagtacctgggataacaggcgtgtgccaccacgcccagccaatctttgtatttttagtagagatggggtttcaccatgttgatcaggctggtttcaaactcctgacctcaagtgatccacccaccttggcctcccaaagtgccaggattacaggcatgagccaccgcgcccagccacatgccatacttttgtgagttttaccttcaggagttctactggtttctcacagtaaagactggagaaaacccccctcatgaggtttcttacaaagctaaccattctcctaccataccattttcatcaatcacactccttagtatttactcaaaggacttgaaaatgtgtccatgcaaaaacctgcatactgacgtttatagcagctttatttgtaattgccaaaagttggaagcaaccaagatgttcttcagtaggtgaatgggtaaataaaccagtacatccagagaacggaatattattcagggctaaaaaggaatgtactctcaagctatgaaaataaatagaggaatcttcactgtttattacttagtgaaataagccaacccgaaaaggccgcatgctatatgattctaactatatggcattcaggaaaaggccgaactatggagacactagaaagttcagtggtctccagggtttgggaagggtagggaggggtaaacaggcagagcatacaggatttttagggcagtgaagctattctgtgtgatactataatgatgaatgcatgtcattatacatttgtcaaagcccaaagaatgtataataccaacagtgagccctaatgtaaacttggactttgggtgacaacaatgtgtcagtgtaggttcaacaattgtcacaaatctaccaccctggtacggggtattgctgacgcagaagactgtgtgttgtgggttggaggaaggaggtatatggtagctgtactttctcttcagttttggctaaactgttaaaaaaaataagtgttcttaaaaaatgatcatgccaggtgcggtggctcacgcctgtaatcccaacacttggggaggccgaggcaggcggatcacgaggtcaagagatcgagaccaccctggctaacacggtgaaaccccgtctctactaaaaatacaaaaaattagccgggcgtagtggcgggcgcctgtagtcccagctactcgggaggctgaggcaggagaatggcgtgaacctggaaggcggagcttgcagtgagccgagatcacgccactgcgctccagcctgggcgacagagcgagactccatcaaaaaaaaaaaaaaaaaaaagatcaaaagtctcaaagcaacaatgtaaggtcccacctcaagaacttaaaaaaagaagagcaaaataaactcaaagcaaatagaagaaagaaaataataaaagcagaacttaatggaaacaaaaacaaaaaaaaataataaagtcaataaaacaaggagttgattcttggagaaaacaacaaaattgtcaaaactttaccaagactgagaaagaaaaaaggaaaacacaaattaccaatatcgggaataaaacagaggctatcagtagacattgcagacatcgaaagaataacaagaaaatattacaaactgctctacacatataaatttgataacacagattgcacaaaaagaaagtaaaatactcagatatacatctatcaaaactttccggccggcacggtggctccatgagccgtgttcgtgccacggcactctggcctaggcaacagagcaagaccctgtctcaaaagtacaaatttaaaaaaaaaaacttgcacaggatctgtaggctgaaactacaaaatgccagtgaaagaaatcaaagatctaaataaatggagaggcatcacatgttcatgaattggaagactcatcacagaaaagatgtcagttctccataaaaattgcataggtttaaaaaaatacccatcaaaaccccagcagagttttttgtagatatagacaacattagtttaaaatgtatccagaaaggcaaaagaatagctaatacaattttgagaaagagaaataaaatgggagtaatcagcctacccaatttcaagacttacaatacagctacagtaatcaagactgtgttgtgctagtggaggaagagacacatagatcaatggaacagagcagagtatccagaattagatgcacaaaaatatgcacgactgatatttgacaaaggcacaaacacaattcaatgaagaaaagttggccttttcagccgggcgcagtggctcacgcctgtaatcccagcactttgggaggctgaggcgggtggatcacaaggtcaggagttcgagaccagcctggccaacacggtgaaaccccatctctactaaaaataaaaaattagccaggcatggtggcaggcacctgtagtcccagctactcgggaggctgaagcaggagaattccttgaacctgagaggcggaggttgcagtgagccgagatcgtgccactgcactctagcctgggcaacagagcgagactccatctcaaaaaaagaaaagaaaagaaaagaaaagaaaagttggccttttcatcaagtgatactgggacaactggatagccagaggcaaaaaatgacccacctaaaccccacaccttctacaaaaattaactcaaaatggattgcagacttaaatgaaaaatgtaaaaccataatacttttataaataaacaaagaacatctccagagtttagggcttacacttgatagcaaaagcactatctgtaaaaggaaaaaaactgtatattgaactttatcaaaattaaaactttttgctctgggctgggtgcagtggcttatacctgtatcctggcactttgggaggccaaagcaggaggatcgcttgaggctaggagttcaagaccagcctgggcaacatggcaaaatcccatctctacaaaaaattttaaaattagccaggcatgctggcatgtgcctgtagtcccagctacatggaaagctgaggtgggtggatcgcttgagcccaggagtctgaggttgcagtgagctgtgatcacaccactgcactccagtctgggtggtaaagtgagaccctgtctcagaaaactattattattattattattattattattattattattgttattgttattttgctctgtgaaagactgttgagagggtgaaaggcaagctataaactaggagataatatttgtgagtcacttattcaacaaaggacaagtatttagaaaacataaggaatccctaaaactcaacggtatgaaaatacgccatccagttagaataaaatgggcaaaaaatatgaagagatatttctctgaagaggatgtacagataacaaataaatacatgaaaagatgctcaacaatgtcagccatcagggagatgcaaattgaaaccactatgcgatattatacacatctatcagaatggctaaaatacaaaacagaatagggacaacatcaaatgctggtgaggatgtggagaaaacggatccctcatacattgcaggtgggaatgtaaaatgaaatagccccctggaaaacagtttgacagtttctttaaaaaaaaaaatctaaacatgcaactcccatatgacccaacaatttcactcttgggtaattatcccagagaataaaaacttaagttcagatatgaacttatacatgaatgattatagcagccttattctcaacagcccaaactagaaagaaacctaattcctttaatgggaaatggttctaaaaaagatagtacttttatatcatggactactattcagcactaaaaaggaataaactggtcaggcacagtggctcacacctgtaatcccagcactttgggaggctgaagcaggaggatcactgaagccaggagttcgagaccagcctaggcaacatagtgagaccctgtctctattaaaaaaaaaaaaaaatagctgggcatggtagtgcagcctacagttccagctactccagaggctgaggtgggagggtcgcttgagcctgggaggttgaggctgcatgatcacaccactgcactccagcctgggtgacagagtgagacactgtctcaaaaataaataaataaataaataaataaataaaaggaataaactattgatacaaataataacctggtaggattggcagaaaattatgctaagtgaaagaaagccaattataaaagtttatatattatatgattccattcttgaaatgggaaagttagagaaatgggttaaggagggagtggctgcaggaggcaagtgggtgtggctataagagagcaacacgaaagatcctggtagggacagaagtgtgtgtatctgatgtgttatgtcaatgtccacatcctggttgtaatattgtactgtagttttgcaggatgttaccatagcagccaaggatacacaggacctctagattattttgtacagttacatgtgaatctagtatatttatctcaaaatagaaagtttaattgaaaacaatcaaacattaaaagatgcattaaaagatggagtcagtgacattttccaaaagtagaacagcaataaaaaaataagatggaaagtaggaaacaaacccacaagaaagagatggcattcattcaggtggtctgaaattgtgaaggctaattttatgtcaacttgactgggctgagggatgcccatggctaaacattatttctgggcgtgtctgtgaggctgtttccagaggagatccacatgggaattggtgaagtgaataaagcaaatggcctccctcacttgggtggccatcctccaattcactgagaacctgaataaaacaaaacagcaaaaaagaacaaatttgctctgtttgagctgaaacatccttctcctgcccttggacatcagcacccttggttctcatgcttttgtgcttaagctaagacgccaccagcctcctgattctcaggccttctgacttccactgatctccaccaccagctttcctgggtctcagcttgcagatggcagatcatgggattcctcagcctccataaccacacaagtgaattccataagaaatctcagccgggcacggtggctcacgcctgtaatctcagcagtttgggaggctgaggcgggtggatcacctgaggtcaggagttcaagatcagcctggccaacatggtgaaaccctgtctctactaaaaatacaacaattagctgggtgtggtggcacacgcctataatcccagctacttgggaggctgaggcaggagaattgcttgaacctgggagtcagaggttgcagtgagctgagatcgtaccactgcactccagccctggcaacagggcgagactccgtctcaaaaaaagaaacacaacaacaaaagaaatctcaatctttctctctctgaaaaagcaagagagcatgaatgtcatgttggttctttttctctggagaaccctgactaacacaatacagacatccaactcagaagagttccaagaaagaacagagaaaacagtggggaaggagattatcaaggaactaatacaaaaaaccaccagaatgaaaggaacttatttcccacattgcaagatccatataaaggtaaatcatcacaaaatgtcagaactctagggtcaaagaacacagagaggaaaaaggaaaagggtcttctgggggttctgtggtataagccatatcacttctcgctcccctgcccgccccccgcccccgcccccgccccccactgctgactgaggatgcagtagcctcccatctgcgaagtcaatgaccactcctccatctgcttcccagctccattctctgggggtcttgctcatcttactgtcagtttagccaagattcaggagagagctgagcctaatacctgggctcagtctaccctctcaactcagaagtcgggcgctagaatgttaccctacgttagattctgaaatccaaatttttgcttctgcctctggccacctcacaagggactcacgtgcaaccaagcatcggcgatgccttccccacctctcaggctgcaacctggccagggcggctcttttcacgtgactttgcccttgatatgcttgttcatctgagtccatatgttacctgtttagcaagtgggtgatggcgtccctctgtgaggaggtagacggatgctgagaaaattagttcctagtgcaactcgaggggtggggagaggcttttgcctgccttacatcaaccttgctaagatgttattttttaattacacaataatatttgaataatatcacaaaaattaaaccattacaaaagattcctcctatacttgccatttccaataccagaggcataaatttccagtcctttttgtatacattttcctagatgtttatgtatccataagaaatatattgtgctgctttagtgtggatttttttttcctttaacacatgagaaaacggtatgtcatattgcagtttgctttttttttctttttcactcaataatgtatgtcagccaccttcccatgtcaggactggcaaatctcccatctttacattttactattacatggagtttatagtaaggatgacacattttatagccattctgcttgggatagatgtttccgtttttccaggatttttgcaagtgatggggctgcacagcagtctgtggtccaaagccccgtgccggcccataggtgcagtttattagccgtctaccacaagataagaacagaaatttgggataggtgttgagaaacttttatagcaatttggcggggtaatgtcatatcgaatcttccaataaaaattggaggcttatattttctaagtctttattttttaaattttcacttctctagtaattcatttttactacaaaagtaaaaatgtacgtgtttatgacagatcagaaataaaaactagaccacagtctgagcacagtggctcaagcctataatcccagcactttgggaggccgaggcgggtgatcacttgaggttaggagttcaagaccagcgtggccaacatggtgaaaccccgtctctacaaaaaatacaaaaattagccaggcatggtggcatacacctgtagtcccagctacttgggaggctgaggcacgagaattgcctgaacctgggaggcagaggttgcagtgagccgaggccgcaccactgcactctaatctgggtgacagagcaagactccatctcaagaaaaacataacaaaccaaaacaaaacaatagaccttgcccccagattcccagatttttgagaagagctgcttttgtggacagcttaatgcatgcctaccctctcattctcatgtcagcatctctctgccataaatctaaagaatgactctctggggcacaggatttagacatcatttattgtaatcgagagtggcaatttgcccctcaaaaggctagatccccaccaccattggtatcttgttgtaactcacatgttcctgaataccaacgagacggagcttctttttgtatgtgtattatccatatatatgtcctttgaagccagcctcaagtccaggaagtcagccaagtcctgggttgtgataatcctcctgcagcctcatctggtttgaacttcccagaagtcctaggaggtgaaccaggcagggataatttcctctttaaacattccagttcctcctgtgggacattgaggctgaggctgcacccaggccacatgcatatgtatttattggcagggctgggcctgagactaggtctcctagcctagaattccctccaaagattcacgagagtccaaagactaacacccatggcccgggtccaaaagttcactaagaggacaggctgaggctacatgatgggggaaggggggagtcagaattagggccaagaactagatctgggaggtcagggagggaaaggagaaacagtgagaaactgtgacgcagcacaacatatatctcagcactgggaatgtctatcttctggcgctgtcggaggagataagtagattatctgtcagcccaacagtctaagcaaagaagaagccaggagttccttccgtcaattcacctaatcttttaacactgcttatcggtggggtcgatgtaactcaaacctcctaaaacaacacggggtttatcctgtccgactcaagcaatgaacttgcaactaccaagacatcaggccaaaccatcactcattttgctcaggtgtgcctttgtgcaaatactcaccctgccaagtctgggaggccatttccagaaaccatgggtggtgggttgtaatggccggtctgcctcgtggcaggcaagcaggtagcagtgaaggaacatgccatgagaagtgggtgcaaagagagaagatctcagagttgggtggagacttagaaccatctaacccaatccttacccacattcataggttcaagtaccaggtctctgcaccatttctagacattacttagcttccctgaacctcagtttattcatctgtaaaatgggctctgcctgcagtgggtgacattggggctgcacctgtatcctgcagaccctgatcatccctgtgtacaactttgcctgtgtgcttagaagtgttagagaattcacactcccaggagcaacccccccaaatagcctaacaccccaactcctgaggggcaggatcattcttaggtatgagttctacactgtctcccagggaccccccatgagactgagctccagctacccacagcaatgaggtgcttgacaatacaccccaaatcagtcgccctcctctccctctttcacttccctacagccccttgagatcactgtccatataaaacacttgcacaagaatccatgcaacagagtcagcttctgggggaacccaaattaagaaactttccaactttctcacagtgttgttggtaagatcaggtacagctctcagacaaaggtcgaggttatcagcatgaaaccgtggcactattctgtgtgccaggcaaagggagccacaggttagtctgagttgggtattctggggcttttgaactctaggtggtcacatggagactttaaggtagaatgaacataagccgtaaaagacagcagagttggagcctactgggctccgcctggttttaactgctcccaacacaacaatcacaactgccaatctccaagttccaaagaactggctctgccaacgactcagaaataagttttgagcataatctagcccgtagttgatatcaagcagaagatgtgatctgtggttctcatagctcacaatctatgcagaacccaaagagaatatgtaacaattaactgagcaaaaccagcagcaaatcctggaacatcgtgtggaactagaagaagatggtggtttgttgaaagaacacaggagccctgaaggagctccaaatggtcaaggttggaagaatttaaacaataagaaaaataatgatagtttaggacaataacccatagagttaaataaatgtccacaagtccacactgatataagtatttgattaaataagtcaatagggaagtgacagctcttccttgcaatgaaaatccagtcaatccatgcggaaggaaggagcaaaggagaaatcagcattaggtcaacaccacagtggtgattgttgcagacaagagctgctaatagacaacagaataggtggaaggtttgaggaaaaaaggggtttgcaaagccttaagtatctcttccaggaggtttgttgacaagggtggggtttggggacagaaaaaacattaccaaggaaaagcccatcagagaccacttgaccaggtgatcagggccatcatcacagacgtaagccatcaacgccatgcccccgtgacacgtgcagtgagcaggatgcagccccaggcctctggcgcccttgcctgggatgcacaacctgagcccaagttcagacaggcctgaactaagagacttctgcaaagtaactgatcaatactcttcatgggtatctaggtcctgaaagacaaggaatgaccaaggaactattatagagtctagaagactagagagaaaaaaacaactatatgcaaatgcgggatcctggatgggattctggagcaagaaaaagacgttaatgggaaaaccagtgaagttcacacgggatctttggtttgattaaggctgctgtactgaggttaatttcctggttctgattactgtgctatggctttgcaaattgtgctatggttttgcaagattggggtcaactgctggagggacatagagaagttgcctgtaccaggcttgcaaattttctgctacttttactactagttttctaaaagtgggtcaaaatataaaggttttttaaaaaagcatcaaatgtccagtttttcagcagtatctttattagaaaaggaacaatccccacattgtgttgatgtgagcagtactcaaaactgaggcaacagatctcaaaatattttggcatgtgggagtggggaggtaaaggctgaagcctcctctgtccgaagcatgcccccgaggctgggaggaggcaaaaatgacaaatcacatctgaatctgtttggcagaaaaaatgtccagtgacctgtccgagggccagtcacacatttatcaggagtattagcagctccgcattcccagtgcaggtctcccaggtccacgccctagcctcagcccaggacaggctctgatttctccgaaaatgatgtgcaaatctgtttcaaaccacatgaccttttgccacaacctctttgtggcttgttctattggatcagaagccaggagtattttcggaacattgctaatgctctgagcatctcagttctaggcctgtaggccacatatgatgtgcgttgggccagaggcccaggtcaaggtgtctcgagggaaattggagtcaatggtgaagtgagaaagctcttgtgaggcctttggccccagtgggagggccagggacagaggtgggcctgcctggtgagcccacctgcaggcaagaggcaccctggggaggtgccaggaagcagggcgcaaggcaaggaggcaggaacagccacgtctgctcctgccctttaaacaaataccaggctgttcgagtccagagaagaaataaatattgacaaaggtgcggagcggcaggaaggccaggtggccgaggccccagaaggaacatggcctagatagggtctcctgggatgactgcgaggaagcctcagccccgagccaccctccccaggggcccttggcgaggctgcctctacggaggtccttcccccgtctcggcaggtgcttcggcaccttgagggcttggactcaggctgtcaggatgaggagcctatccacgggatcagttgctggtgtttgccaaaggtgtgtcccagaggggccacccgtagcctctgacggtgccacggctggaaggccctggccaaacacctgtcccacttcaacagcgcgttcagtggatcccccaaaccaaagggcctgctggcgttcttcagtgagcttctcaaagtgtgggtgcagggctctcaatagaggcccctgggcgctgggtaagaggcacattcctgagcccacacctacccctccaggacactgcaggtcgaagctcaggaatgtgcattttcaccaccttccctagtgattttaggcagagggctcattagagccaagtaacagaagaggaagcgaagtctcagagagggagcagcactctttggcagcacagggagtgaggggcagcgagggaggagggtccagggcagagtgaagtggccacacctgctctgtcccttggctggaaacagcctaatggtccagacgaccccctgggctatgggagctcaaatcacttcccgccagaaggcttctctgacccctcacctccagcccagggagatgcccctgcctgtcccctgggctccgcggcccctgggcttcctgctcccctggcactgggcacactggaatgcaaataaccaccgacccttgaatgtccccaccagcatggtgcctggcgtgtagtggatacggccgggatgcaggtgcttgagccatgccatcaggaatctctcccatcatctcagtcctgccttcccttctatggccccctgcagtccccactaaccccagcttgccctgcagctccaacagaatgggagtgcatccccaactatcagcccggccacagtcccggggctccctgtccttggactgccaggggtcaggtgccagtgtgtgagccagtatctgtggctggatgcaaggagatgaggctcccctaggctagaccccagtgctctggccacagctgcatgcggggtgggggcagcctaccagaaagggcaagactggaagtggggaggtgccccacaggaaaaccgggattctaccaagggcaggaggctgggcaggcggaaaccagcaccatccactccagcccacctgccctcctgacctcccacaatggctgctctgatgaccagaaggttcctcagaagccagttaaatctgtttctcctaccccacacacctggctctgcctcttcctttgttcccttggtggtcctgaaaggctggctggctgctgtcacgttccccaccaaccaccccaaaccccactcccctgccctcggggtatccctggtcccccccaccttctcatatgtgcagtcttcatgtcgtggattccagaccccggccctgctggctgcctgcccagccaagaacacctgccgtggacacctccccacgcctgggccaccacctgcccagtcctcatcacccgccatccaaaaagtcactctggtgttgaagactcatctaaacctggaccccaaaatgctactggcatttagtcactattccacaggcccgttctgattatttgttattttattttatttgaggcagggtcttgctctgtcacccaggctggagtgcaatggtgcaatcactagctcactgcagccttgattttctgggctcagatgatcctcccacctcagcctcccaagtagctgggaccacaggcacacaccaccatgcccagctaatttttttattttttggtagagacagggtctccctatgttgcccaggctgcgtgattttaaaaacataaatatctccaaattatctgaccctcctagagatgaaatctccctgtggccgctgttcttttttttttttttttttttgagatggagtctctccatgctgcccaggctgagcttgaactcctggcctcaagctatcctcctgcctcagcctcccaaaatgctgtgactacaggtgtgagacatggcaccaagcctgtggccactttttctttattttcacatgagataaagacaccacctgagaaagtatttgagtgtgtgtgtgtgtgtgtgtgtgtgtgtgtagctggggtatggagtcacatgtgcgtgtgggaaacaagcctgaagggttgctttggcacatcacctctgggtcttgccattgcagtgatttatttgcttttctgtattttctaccttaacatgtaattttggggaaattaaaaaatcaatttaagaaacttaatggataaacaaaagacagtcaatactggaaaaggcacaaatcatgaaggtaaacccataggcatggatgtgaatctcagcagtgtgtggtcttgggcaagtggcttgtgcctttgcctctctgaggcctggtttctcacccccccaaaatgggggattatatagtaaatggcaaaagtggctgtaatctttgccacttctcccatcaaaagatagagtttgttttccctccccctgaatctaggctgcccttgtaagttgttttggttagtgaaatgcaggagaagggatggtgtgcttgttccaagtggacctcaagggccttgcagcttctactcactctcttggaaccccgcccagctgccatgagaacagcctgggctagcccactggaggatgagagcccacacagaactaagacaagctatctcagttgaccccattctgagccagccagctggccccagcagacctggaagttgacctctgacaactgagtgagcccagctaccagaagaactgcccagctgagcacagccattagaaataaatagtttgggctgggtgcagtggctcacacctgtaatcccagcactctgggaggccaaggtgggtggatcatgaggtcaggagatcaagaccatcctgtgaatggtgaaaccccatctctactaaaattaaaaatacaaaaaaaaaaattagccgggtgtggtagtgggcacctgtagtcccagctactcaggaggctgaggcgggaatggtgtgaacccgggaggcagagcttgcagctagccgagatcatgccactgcactccagcctgggcgacagagcaagactccttctcaaaaataaataaataaataaaataaacagtttgggggtagtttgttatgtagctaacaacagctgacaaacacactaaacatgcccctaacttatgacctttgcccttgctctttgctctgcctgaaaccccactccctgcaaactccatgggccttttctctctcactgccttcaggtctctgctcagtgaggtctcccctggccagtccatataaaaagcccctctcccatcactctccttcgtatatatcttgccatagcacttaccacctcgcttctttatgtatttacttgcttatttgtttattgtctctcttcccccaacacacacaccatggaatatgagtgtcatgggggcaaggagattctctattttgtctaccactattagcgcccagcacctggtaggggttcagatatttgtggaataaacaagttcatcttttgccttaggggctcccatccagctggccacagcgctctcactaagaagacgtattctgggcacctcccagctgcccgcctggctctgggccctcaatccctgaatgacagtggtcactgcacttgaataaccctctagagtgtaaagggacttcctcctttcctgcaacccactaatggggtctgcagaccccactctccagccctgtttctcaggtgagataactgaggcggagagactagtgcaggtgtagggacacaggtatcttgtggcacatcttgcctggtgctccctcaggccattggacagaggcacctcctcccaccaccaagagctgggccaggcatcagggatccctggtctgagccttttcttctcctaacttgcattgagacctgaacagtccctaacagggagacaaaaaaaacttctcaacagtgagaagcctctgacaatcccagcacctcattaaatagactttcatcatttcatgcaaagctaccaaaggaaagaaaacatcaggggctgttagaccttggccaggggtcccctcaactctcagagcgtcaggaaggctgaggaagaggggtgagggggagggtcccccgcagcctctggctggcctcacccagccatctcccatggcacctcctgccctggtcagaagccctcctgccctcctgggcactcaggggaaatcctctgcaacttgggatgaaaaccacagagcaagagtccctggaattcacgtgtgactgcttggtaatgttgccttagcccagctttccccaagagctgacccaaaaggaagattcaagcagaagcattttgtggggggatggccccaggaagccccagtaggagtgtgtgctaactctgggcattcccagcttggtggagtgtgcccctgccatcaggggtgcccttgagaagagaggcaggcaggtcctgatgtaggatgccactgggtgtgcaggaaggaactgcaggtgactttgggggtccagggccctgaggaaaactgagaacagcactgctgatcccaggggaggggatggagagcaaagggtgactctagggaggcatttcagcagaggagacccatgagaaggggaggaccctccatcttcaggctgggtattgaattttccaagcccacctggctaacgactttgcccccagaggcacttgagcaaagggccagccccagccagagccaggagagcaggctctgcactgccgcaggagagctgctagcccagcctggctacaccatggaagcccaaagacaggagctcttttacagaaatgaaacccctagaattagtccccagaccaatggctctgcatgcaaaggcacagacagcatagactgaaagtctactgtgtgcatagctgcagccaggagatgggcaggggcccataagagaacaccaaggtcatgttcattaagcattcactgaggctgtgcatggcctacctcagcgctcacagcccctcctcctagtggcaactacgactctcccctgagataggaccggtattccaaacacctctccggggcaggcaggggtggcagccccttcactaactggactctccttttgtgctcagagtaacccccctcccattttaccaacgtggaaagggatgagcttcaggagcttggccatggtcaccggtgccagggagtgagacagaggcagaaccctgggaggcctgggtgattcaaacacatcacagagtctttaccctaagggagctgcaatccagccggggaaataagaccccgaggaaaatgagcaagagcagttaaaccgcaacataaggcaataatacaaggaggctaccacccagagccggacattccacacccagcagtcggcctcgccgcctcccgcccgcttcttcttgtaagggcctttctcaagaagtggctaaaaagggacttaggatagcacttggcggacaaaaggggttgttggcccctgctctaaaacatttgccaacacatcttcccatcccctagggctttaagaatgatccccacccttagctagtcagtggctgcaaagcagcccctttcattaagccagggaggggggtccagtggaaactgagcccccgatctttgggaaactgctgaggaggctataaaattagagagaaggacgagcaaattacagagagggagtgggcaggcagcagggcctttcatcagcctgattagctaaggaaagaggcccagccatgggggaggaaggccaggggaggtcgccggctacctcctgggggattgagggcccctccaaagttcaggggcctcagcccaggcttctgccttcaggtcaaacctgtccttgcacagtagggggaggacccaacattttaccgggatgcaccatttctcaccctctgactctggggcctggctgaatctcctggagtctcattctcctcatctgtaaaacagccccggctcacaggatgtaactgtgactgaactaaacaagtggttggttctcaaccctagctgtacatcaggaccaccaggtgaagacatgttaaacctccaatacttaggctgtaccctgtactattgatatcagaatctttggtggggggtggggagggttgggtgggaacatcccaagcacagggacaactggaacagagggcctgcgcaggagagcctggggtgtcctggaacaggtgtggctggatggggatgaaggagagggatggcacaggagggaagttcacagaggtcaggggagctcagctacacttgcagatcacaaaccaccccacatttcatgcaggaaacaaccacaataaaaccaccaccattttattgtgcttgggcttctgggaggctagagtctggacaggccttagtgggaatgactcgtctctgttacataacatctggggcttcagctaggaagatgtgagtgtcttgcgggggcaactgtctaatacagtagcccctaggctcatgtgactatttaaacagaaattaattaaaattaagcaaaataaaaacttagcttcctcaattgcaccagccacattccaggtgcttaatagagaagtgccagacttggctgggcgcagtggctcacgcctgcaatcccagcactttgggaggccgaggtgagaggaacccttgagctcaggagttcgagaccagcctgggcaatacaggtagaccctgtctctgtaaaaaataaaaaattaaaataatttttacaaaagagagaattgccatacttggcagataaaaatacaggacacccagtgaaatccgaattttaaataatcaacaaatttttttttagaataactatgttccaaatattgcatggtatgtattacactatattatttgttgtatggaattcaaatttggcagtgttccatgttttatctaaatcccagctaacatgtggctaacgaccactaggctggacggcacagataccgaacattcccgtcacacagaaagtccttatgaacactgctgctctggagaggtcttcactcacctgtctgcttcctgggctgggaggacgtgaagacggggcttcactggaatgtgggacctctgtatctggcgtgggtcctcacggatggcaaccacattccaagagagtggcccaagagcaaggcttcctccgctctgtacctggaggttacccgccagcgtcacttctgtcctgttctggtgggttacacatgtgccattccagccaacccaggttcaagaggagggggatccgattccttctgatgggaaagctgcaagatcacattacagaagagtatacgggactggaaatattgttggaaaatacaacgttggagttggggacatcaaatcacgtagggctttgtagttgttggaaggactggggctttgagtcaaacagggagtcatgaagggtatttgcagagtagggtcacaatctgactcatgtgcgaagaagattcctttggctgttgcaagtgaataaaacgtagggggtgaaggcagagtctgggagtttccttaggttgtacctagccctaaactaaactgaaatcagaccccagcctagtacttggtggtggagttggcatgacgatcccagcttctggaccctatttccctcttccctgcaacaaggacccttgcaagtagcccctcccctcacaccagcttcacctcttgcccccaattctgaggcgagtcacatctggtcagtttcactcccccgccccctcctatggcgacaagtgctttaacagacagtgcaaaaggggtcaaaagcactgcagacatgaaccagactttagaaaaacacatagcgcgagccctgttgggattcgcagcaggcgtttccaatgtttttctcgagactgcaggcttgggatttcctgtcttctgaggcattcgctgagcaggccaagatcagcttcataggaaggcaggaatggggcttcctacattgctgtctgcaggctctctctggctcctttcctctcctccccttagggtcttttttgtgtattctttctcctacttctgacactttttctgcccccagataaatgtccagccacctgcctcccaacaggactgaatcacgggatcatgatacaatcaacaaatccaaggagctgagaggccccgggagctgcagctgcatccagctggaatcttgaaggctggctctagctacgggtttccaccctcatgcgaagtgtgccaactgcttcgcagaaacctcctaacttcagcagggcagagcaatgggaagctatgtcaagaattgctatgggtatccggcctgatttaggggtaactgatacacagcctaacaccgcacagcaccgttcttattaactgttccttgactttgccctgtcttaggttgaccgtccagagcatgggtcatcccctccctgtctttttgcaatgtagagaggatggggtaaacaacaaacacatgacctccattccctctccaaaccccatcagaacaactggaaaggatctgcaatgtaacagttaaaaagtaaggccgttcataaacagttcctgaaacccaagcagctggccagtctcctgctccatttccttgcagcaagtttcagtggaaactctataccccaaacccccaaatccctaccctttgactgatgcgaaaaatccccccaaacaggcctttgttcctttagctgaggacacaccaaatgtattaatgaacgtggataagagctggaaggcaactatcagaagtggctgtggactaggattacaggctgttattttcctggcctgaatattacaggtcccacaacttaagaagctttaaaggaggtttgtaaagcatgtattaaaaaataaggcaggcccagttgggcagtggctcatgcctgtaatcccgttttgggaggctgagatgggaggactgtttgaggccaggagttcaagaccacccagggcaatataacaagacccgtctctacaaagatttttttaaaaaaattactcaggcatggtggcgtgtgcctgtaatcccagttacttgggaggctgaggtgggaggatggcttcagcccaggagctggaggctgtcatgagccatgaccgcaccactgcactccagcctgggcaacagtgagaccctgtctcagaaacaaccaaccaaccaaaaaaaagaaaggctcaattaaaaattaaaatcctcccaaacagctacctaaaccattcacaacttctagctaatgaagactttggttgggtggggtggttgctgaaggcagggaagaggctgggaggctcagggcctctgtgcttgtctgcagggggccctcacctcttcctcatgggaagcaggccgtggaaggacaaagatgcaaaagagctgttttggggcctcaggaaaactcctccatggatctccacggagagagagaaccaacagcagaaaacctccagaatccaaccccaatgctggcatcctgaatcgttttttgtaaacaattcctattcggataggaaaaaaatctagaaacatttaataacttattcttgagatgtggtattttactgttattttgttttacaagatgtggggacttcattaaatccctacatgtattaaagttagaaataaacattaaaaccaaaaaagtcaatggttttgaatggtgacaaaccaaacctccaataagaaatcactgtgggcagctcacccacgcaaggggcaccttgtgtatgtgcgaggagtggatggggaagggcgtcccctggaccttgcagacccagctgtgtctaaaggacataactgatcactgcccaaatgttgtccaccacccccaacttccttccagacacatcacatggcctggctgtgaacccccatcaacatcacaactgttttgacaccaggctcagatggggagttctcgaacagcatggcctcagcaatggaggttgtgtcttgggtaaccagaaacctgaagcccgcaggaatcctggaggggactgctggtctgggaaaacaccattcagaactacttaactctcaagtagcctgacatttctcttcctgctaccttagctataagctgataatctgagcagctctgcggggataccaggctcctgctcagctgtgggtgggcaggtggctgtgctgggtcgcccctgccgcctacaggcagaaagcggatggtgcaaggtttccttccaaacggaaatcgcccttcacagagctgagcctgggaattaccacaaagaaacctcacaaagaaaaggtgcgcaaggcaaatgttcagaaaacagacccctaaaccctgagatggcacaagtgaatgtgttgggtggtgaactggccaaatgcttgtgctctgtcaccacaaacgaccccagtggtctgacatgacctcaacggcttcacagaccaggggtgtgctttccttcctcgtgacaatctcctaattttgcttttcagagtgggggagggcggggagaggggaggtggatggcagttgtccctgttgtctagtctggagtacagtggtgtgattttaacttactacagccttgaactcctgggcacaagcagtcctcccaccacctcagccctccaggtgtatgccaccactgtaggttagcattttttgtagacacggttgcgctgtttctcaggctggatcctagcttttaatgaaatcgtatgacatgtgaactgtgcagttttgcgtgtgccacgaggcaactttctcagccgtgccttgggcaagtcacagcctttttggcctggatgccttaaggcagcccatctgaaaccacttcccattcccatttctagaaaccttcaagggttccctatgaattgtgcacccacatgggttttcctggaggatcactagttctcagaaccatacaagcacacagcaaaagcctctccacacatcaccctgaagtgacccaaattcccatttctcaatgtgggacctatgctctcctgcactccagcaagatagctgtggattcccacctgatgctgttcctcctgctgccaagtgcctgcctgcctttccaggtctcagcacaccacacaggtcgcagtcagcatctaaacccatccccccaccccagaccactatgaatgcaccctcacatacaggtaaaggtagcaactcactaggtgactgacagaaggggaaaggtgactacatccctgacccagagtgcctcaaatttcctaagtgactgtcaggtgcaatttaatgaaaagccttggaacaaatacagcaggtaaaacatctacaatcataccatccatgaaggctgtattagagattgctggcataaaactaatttgaggggcctctgaagtgctgactccagctcacagatcagtcagctgagagaggcagcctagatcacttggtgagcagcagacccagcactcaagattcatgcctctgctgtccatttgacaaggtttagtctcaagaaaatgcaccaaggccccgaggccaacagccagagctccaccaatcagggctgatcacactggtgctcaagcactgcggcccaggaacctgactgcaggagtgctggctctacactaacagaatgctgggcgtgtgtgggtggctgctgtggacattatgggggagatgggtaggaaggacagatttggttaggagcccagactgaagttacaactgccaagtttaaattcactcattttgtgcaccgtttcccaagtatgtactgtgaaggtagaaggcactgtggccgcctgtaaatagctggggaggcaagacacgaagaccagataaatgttaagaaacatgctccctgtatgtattgaaatcagttctgcaaccctcataccagttggctgtaacagatgctaaatgtggtgggtaaaatgtttttagtctcatggtcttaccatgaattacttattagaaaggtaaaggagattaccaccctaagtgctcagtcatcaacaaaggaatagacacacaactcctgaagacatgtcattggcaccagggagtggtttcgtggaagacaatttttccatggacaaggtggggtgtggaaagggatggcttccagatgaaaccattccacatcagatcatcaggcatttgattctcctaaggagcgcacaacctagacctgttgcatgcccagttcacaatactgggtttgcactcctatgagaatctaatgctgctgctaatctgacaggaggcgaacctcaggcggcaatgctggctcacctcttcctaacaagccatggacctgagactggggaccactgccctatggtaaaggccctggccaaaatgcaaacctccatcaggtcaggagcaaacagacaaacccacatttagagaccatctaaaaaaggcctggagtacttaagaatgtcaagactaggacaaatttcccctgaccgcccccaggactctgggcagaacctgaaaaccctgtaaccacagccaaaccctagcaccacctgcactcctgggacacactctggttgtagtttccacgaaaacaggccgtacattagtagcacgattattttattatatgctttataaaaaaacaaacacccaaagacatacaacacaccgccctcaccccccagcggccattagggagggggcttatacttttcctaatgtagatctggccatcttataaagcagaccacattatttgtttccatatatacctgtagatatttctctcccctcaaatatttatatctcgactaaaaaaaggaggtgcaaagagtatataaagataaatgagattttcttgctgttgttatagtacaaacaccagatgactaccagtggagtaacagggcaaaacaaaaacacaaaccccaccttcagtgaggaatggaaggtctgttaccgacctcaagtagctgaatcacctgctgtaactggcacctccctgacaatcatgggtttgtagggacatgggccaggtgatggcttctacttgtttccagaaggctaatgtgtcctacaccctttcttagtaactaaagacgaactacgggagaacccagtatttggattctgcccagaggtattaaatgcacaaggaaaaattagttatgtccaagtagcaagcaataatatttttaaaccaacatggttaaatgttaagatttgtagaaatcaaaatatttattcacataattttaaactaaagttgaagctaatatatcttccgtggtaatgatttaagtgcaagtgatgcttggctttctttcacattcatttcttttcttctgagtgaaggcatatcagttattcttgaacaagtcaatacagctctgcaaaagggagacattgttctgtggggaaaaaaggcaaggcagaccagtgaattattaaaacttgccatatacctggaatgactcaagtacaccaacacggcttttcacgggaggtttaaagtcagccagagcaagctggcccttctcttcatcaaatcccaggtgaactgcaacgtaccacgcatccccatttcatgtttcagctcctctccctcagtgggtaaggctaccagccaaagagccgacgttcactccagcacctctgccctcacctgcttgctcctaaatgtgatcctgcttactgtaacttcttaagacactatcagtgcgttgttccatgaaggcaagggccttggaaagattgaataaaagttgctagaaattagggctgggagctttagctcacacctgtaatcccagcactttgggaggccaaggcaggtggatcacctgaggtcaggggttcaagtccagcctggccaaaatggtgaaaccccatctctattaaaaaaaaaaaaaaaaagttgctaaaaattagtcatgggtgacattataaacaagactacaaataaacaatgagtggctcccatcaactaagtactacagacgattaataccacaaggccaccccaactgcctgatgacaatgggttagtaaactgggaaataacttggaaaaaaccataaaagatgttggcttcatctgtagaaaacacttaccctggcatgttttatttccagttcagacatttcaattagattctttctaaatgctgccactctcttccgtttgaaatttatcagttctacaggaagaaaaaatgtttatgaaaccaagaaaaactaaacaattttcatgttcactttaactaccaaatggcattcttacaaatggtctccaatgctttcaggcaccagcattatttcctcacatttgtattatctctgtgactgggacacatcagacatctattaactgtggtgatacagctatcactgtctttaagtggaaaacatcactgaatcaccaagcatcgtgagtgggagagcagcagcttatgacttggagaacacgttgatgagcagcctcactctcaccctctaggtaccagtgactgggaacagggctggagtatgggtggtggtgagccacatacttcaccaatggcttgtgaaaatgcttctcaaaagaagacataccaggttcatgcaaacaacgttcagcagcactagccattagggaaatgcaaattaaaaccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaattgagaattatccatcagtggatgaagacaatgtagtatagatacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaataaattttgagatctactgcacaacagggtgactacagtcaataatatatattgaaacagcaaatttcaaatgtattaccactgaaaaaaatgaaagatgttaattagcttgatctaataatttcacattatgtacctgcaaagcatcacactgtattccacaaatgcaatacaatgacttgtcgattaaaaataaaacttaaaacatttttaaatccaaaacagtgaaaaactgctacacgtattcaagacaggtttacttgatgatctttagggcatgcttccttttcatctactcctttttctttttttttcttgagacggaatcttgctctgttgcccaggctggagtgcagtggcgggatctcggctcactgcaagctctgactcctgggttcacgccattctcctgcctcagcctcccgagtagctgggactacaggcgcccgccaccacacccggctaattttttgtatttttagtagagacggggtttccctgtgttagccaggatggtctcgatctcctgacctcgtgatccgcccgcctcagcctcccaaagtgctgggattacaggcgtgagccactgcacccagccctttttcatttcatctactcctattgccatcagaattcggcattaatgacccattggaaattggaacaaaccaagaatatgcatgtccgccctaattccttcattgaatttgtgacatcaagttctgtcttgcagttttacttgactaaaactttgaccatcacccaaccttctgctggtgctcaagtgttcagagcagactcaccctccttcctgtctctacagtgctgtgcaaaagaactacaatacaagcagccacatccaagttaaaaagtcacaaatttcatagtgatatgtcaagtctatagtgcttgcactacaaggtgatgtttatcagtcccttggatatcctgggtgaagataagctccctgccttcctctagacctacacacagtaccagggctccatacacttaactattcacctcctgtgaaaccagcccttacccactgactcaactctagtcgtcagctcagctgcaagtctcagaaagcacttataccaaaggcaaacaggttaagacccaccaatctcagcattccacagaatactgtatttttagatagtgtacctatctggcattttgaatataggatataatcaatgtgggcgaaaactttaggcagtaaaggtagacctgaattggcatcattttttaaagttttatgttttttcttcaatctcctctaaaatttccagagccatgaaactggcctataagatttcaactcagtagttttgaagtgtgtacgtttccttgaaaattttagttttaaaaaaaaaaaaaaagctgtaattgtttcagaaacagggtagcatgaaggttactttggaagaacccaacacagcctcagagcctgtctacatgacatttgccaggaagctctgtgcctttgtgccttacagttaaggcattgtattataatcctgaatagacagacaaatgattagaaatctataaagtctaggtttcccccaggtagcttcaaacatgttgatgaacacatcatttccctatgtctagattaccctaccactgggaaacaagaaagttaggaaaaaactaagtaagatatgaatttttcatggaaacacgcgttagggggttgggattgagtccaacagtgccccactacaactactcacattctgggtaatccattccaacatttgctctgacatgttccatggcccctgagaaccccagagaagatccacagaatcctcttaggtaaggactacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaaaaatggccagtttcaaggctggagcagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatcgtctttctgcaatcgtcagagtaacagctggtttaggcaagaatcattaatacatgctaaacctagggaggaagtttgatgaagaccaaggtatttgcatggtcttaaattgcctcaccacagattgatgggggttaaaatagtaactacacagtggagaaactggatttggatactatctaattgagtaatcaaaattaccaccacgaatgaaggagagacacactgtccaatcagaagtgacaccccaataagggcatattacttctattctgccaggagcccataaccagatctaaacatgaggaaacctaccaaaagtcagaaatacaggatttgtaaagagattctctaaaaagactgatactgttaaaaactaagaactattccagagtaaaggagactaatagctaagacaaccagatgcaatcctagactggatcttgtagaggacatcaagacaaacatgaaaatacagagagcagattgtagacccaaagttaagtttatcacagcaaacaaccatactgtaaccatacaagagaatgtcttcagtcttaggaaataaaccacaacgtttttagggctaaaagaagcatgacatatgcaacttaatctccaatggtacagaaaaaccaggtgtgtaacgtttgtaagcacgcaaagccatgaggatgactgtgcatgtgcaagtgataaggcagaggggtgaagtgctgacactgggtgaaggatacatgggtgttttttgcactatttgtagaacttttctaagtttgaaattattttcaaattacagtacagaaagaagaatgtcctgctcaaccttcttttgcagattcggaaagttgttcaaatttctggcagcactcctgctggtgtgcctcagccaacttgacgtctttgctctttaaccgggccttatccagagctttgtttgagttctcatagtcaatgagggctttggtgcgtctgtataagagatcctgggaaaaaaattaacaggtatacatactaagtatctaaaccagtctaaaaaatagcccaagtgccaatgtaccacctgagatgttagtggcaataatctacctctacaccttccctctcccagagtatttttaaatctccagcttcgcagggatgagcaatgctgatagctttgttgagagctttttttagaattccttatatgaatcaagtgattactcaagagtgaaaacagaaggacttttgttttccagtaattcagtaaataaagttaactttaaaaattaaatattgtgtatcagagataacttgaaatatacagtcactgctgggtaagtcaagttgagcgctgctaaaatacaactgggcaatgaagtagtaagaaacataaccctaccctgcaaatcctgcttctggtaatctaccttggagatccacttagtcagatataaagattctttgcaatcttacaacagagtagaagttactttagtatctgaaatgagcaattatgatgtatagattacacatttaaaactaggtgaaataataactgatgggtgaaactactaggcctatttttgtatatactcaaataatcgtaagtgagctcttaattccatgaaagtagaaaataggctattaaaaaagtatgtttttaaaaactcccaagattcagaaaacatgccaaagggcaaattaactaaaataaaattgcatgatggggggaaaaattttttttactcttttactttctgatgacatttcagccttagagggcatacaatcctatctaattttattttgcctgatttaatacatttcacataaaattaaaacatatttgttcagggcaatgcagacaaagcatgtttcattcccaaaggttattctgcttaccattttgtccacatatacatataacgcttcacggctcaaaggctgcagggatacttgcaattcaataaaaactcccaaatcttctttgccccagaaacagccctttctgcatgttatgtcccacatcaatgacctataatcccccaaactattacctgtctacttcacacaacccatacagtgctgtcagatacacaagctttatggatacaatgccagaaaggcatgtcatttataaaaacaagtctgataaattcttattctgctcctttgtataaagaaactttttaaacagacttctggtcctgcactgctctgagaagctgagcaactctcttcctaccttagcagcttcaatgttgagcatgtagtatcggaggagctctgttagcttcaaatcttcatctgatgaaactcgaccctctactttctatatagaaaaggaaaggtcaccatcaaggcagaaagctatagattataaaatatatattatgaagaccaacacagaaatccttacccttagtttttcaaatagctcagcaaccttcaataggtacctggaaatgtacatataattttggtttaaggtcttaaatcatctataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggttggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatgaccactataaccaaatctcttcaaggtccagggcaggggcacatgttctcaggatctcctgaggctgcatcacaggccaaaaaaaaagaaggtctagggcattaccaggcaaaattgcaagcaccaattgccaggggaagatgcaagataaactcttacaaactccaaaactaaagaaaacaggcttttaagtgtgacagaaactactgctttgacaacatttactgtatttgtttacatatagaagagcccaagtcccctacaattgtcttacaagtgtcttatgtccagagaacatgtaagatgagtgctagagacttgtcttactgagcttgtaactccagagcaggaccatgtagtcactactcatttatgcttttaattacaccactcggcactcttcaattgggttaggggaaatgcttttccaaaaaaacttactttttgatgactgtgggctcttctaaagccaggctatgtaagcaggctgcggtgtggatatagtcatcggcaacatctgcagaaacaaggacaagtctttttatccaaacacagccaggctcatcagcaaagctctgactagcggtaaatgatatttacttttatgagatctggtcattttgtcagctttcacacaagaatctttgatcctattgtaatagttaataaggaagttcttctcttgctcaaagaagtcatctacctcctagaaggaagaaaaaaagaaccagacatttcatgaaatatactatccctgcagccttttacatttatcaatataaaaatatattgcttagaacatggcatataaacgtgagtaaagtttaacctctacagatcagggaattacaaatttacgatactatttcttaaccaaggctgggaaaaatcaagggctggcagaaaatgtctacagaagaatcacttaacaaccaccagtaaaactggcaccctaagacacagcaattttacgctagtacaatggttctaccaggtggaacatggccacttagccttggatacctatctgtgtgtgaatgaggtttttttttctcgattggtttcagactgggaggaaatcctggtatctggtaggcattggccaaggatgccaatgccaaatatcccataatgcatggatacaggacagtcccatacaccttaaactggaccaagtccgagtttcctaatttctgatgatgccctctctacttagcacctgtattctgggctccctggagtggcaaagccagataccagacagtaattgtaagggtaactcagttacaaaggaatgagaaggcccgagaagtagtaaagtaaatcatacctctaacggtaacggaaacgttattttgtattcttgtctttgtgctaacgccttgaaatccagtatgtaaataaaatctaaagtttggttccttagttgtgccagctaggttgcatgtcaagtgcttctctatcacctgtagttggtgaccaaactggacagtgtagttctgagagtgggataaaatactgatcttgtactttattttagaaattaactgagtaatctccctccttacagaaaaggagaaaatgaagccaagtgtggaaaggttcaagttgcttctcctgggacagaacaaggtgctctgggaaataagtgaaaattgaataagtagatgaaaattaccaaaatctgaagaacacttacatgtcttaaaagttaaccatttgtttcacaagtatctctttcaaagaaacaaaaggtcacctattcccgatgaagtaaaaaattttctccaacagccaaaggtcacttaccttaactccagtaaaaaggacttcatcagcacttttcaccacacttttgaagaagccaccaaacatctctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacataggtaggtcatctcattctaaaaggcttgacagattttgaaagactgactagaagctaagtcttagtggctctgaaatccttgggaaaattactgttctcttctatccatattaagtagcaaaaaccaaaacatgttaaaaagaaaaatagcataaaagtcataattcgcggccgggcgcagtggctcacgcctgtaatcccagcactttgggaggccaaggcgggcggatcacgaggtcaggagatcgagaccatcttggctaacgcggtgaaaccccatctctactaaaaatacaaaaaataagccgggtgtggtggtgggcacctgtaatcctagctactcgggaggctgaggcaggagaatggcgtgaacccagaaggtggagcttgcagtaagccgagatcgcgccactgcactccagcctggatgacagagcgagattctgcctcaaaaaagaaaagaaaaaagtcataattcaacaaaaagcgtaggtgggaagaaaataaattacacaaattttaatttccttaaaatgaacttagttaagtttggaattgttaagaaattaactaagggatgtttgggactgttaatttcttaaaaagaaacctaggttttggaaggggaaagaagtcaaaattttctttaagcagagttttacaaaaaatgacttacaatgaaggaaaagcagcatctaaaaaggtttccattgtgtaagaaattcaaaactttaaagcagtagaaactatcaagtacattttgaaagtataaacatttgaagtggattatcaaaatggaataaaaatgccttacatcctgatcatattccaggaaaacatgaaagttgcgatctttactgagaacagggtgagaagaaagccgctgaagaaagacttcatgggaggacacagtcttcttaaacacagcgagatactcactgaaaagagatgtgcacatggcattcagttgacacagctcaactacctgaccaataccactcctgattaattctatggccctgctcatgccaccacataaaacactgcaactggaccaaacagtatttcagtataaactggtgtctagttagatactaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctaagtatacagcatgagtctaatgaagctaaaagttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatggattcataagaaactttccaaaaatctatttttgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaaagcaagctgatcacttgaactcaggagttcgagaccagccggggcaacacatgacgaaacccccaactctctagtttcttctcaacgtctagtaaccaagcttccgaaagaaaagctttgtacattatgagcaatttataaaggcacaaaagtttatttcctcactgtgccagaccagcatccttaataagtatgccctacatatgggaaaagacaactactctatcgggtattagtgtcaatggcctccaatgaatcaatgtgtgaagtacaaagaccatgtcccacactatgcaagatgtattactagttttagaaaacgacgctagggacctaattaaacagctgcacttaaaacaaaattaagtcaggttcttctacttatttttgtacacagcaccacttttctacttctcaaaagacagagcccaccaggaaaatccacttacgcttccagttcttgtttcatcttggcaaattcttctttggtcatagacccttcaccttctcccagtttctgcatcttctctcgaggaccatcaaagtcgggcttcgtaggagcaggtggaatctgcagcagaggcaggaactcatgagcctcttgtcccagcagcgatgttttctagttggtgcctcattctactcttgctggtccacaggagacaaccactccactcctgtggggctatttaaaagtcaactcctgttttttcttaaccttccttaactcttctggacatttaaaatgaggtgtcttcctgagagttgcatattcactttgatggcaatcatttgttcagtttatccattatagacaattgttcagagcacaacagtgtctatactgcttcagtgttcgcctaaaactagtacaacgaatgctaagcaccaaagatgagccatcaagattataaagtgttcagtattccaaaggaattttttcctaatcccaaaggataatcaaggactctaattttgaatgaaagacatatctaaatataagcttcggtattaattttgtttaatgattaagcaatcatcatttggagagcttcttcagtctgcctggcaggacaaaacgcgtggaaatctcctttaaaatcagttaagtctgttcctgccgccaagaaataacaatcaagggctgaaaactgcctccttgagcactttttttgtttttgggagaaagagtctcgctctgtcacccaggctggagtgacgtggcacggcctcggcttactgcaacctctgcctctcaagttcaagcgattctcatgcctcagcctccccagtggctgggactacaggtacgcaccaccacgcccagcaaattttttgtatttttagtagagacagggtctcatcatgttgcccaggcacgtcttaaaattctgagctcaggtgatccacccaccttggcctcccaaagtgctaggattaaaggcatggcctccttcagcaacttttgagaaatcttatcacaaactattaccaatagcagtgtttcctagaaatcaattctactgacataggaaaaaacataccagagaaaaaccaaacctaaaggtaggtaagactaaagtcattacactgttcacacccctttacaatgtaaataatgtaagcctgtatgcaccacctcaaagctgtaacactattccttcacatactttccacttgacagtcagcaaatactccagtaggtagatgaaatctaacttttcacaatccattaaaaaaagtggatataagtctcttttaaactaatgcatagcaaggcagaaagaactagcttatttgattttctaaaagactcacaataagcccagcatagtctgttgtttcaataagagtgtcatgtagccacacaaagtcttcatgttgccttgtaacagaaaactctgggctctgaaacgtgggcagtgtggtctgtaaagaaagaaagaagttaactggtaaccacgacttttagataagtgatctgggtttcctaggctacacagtgggaaaattctgcataatacatcataatatgatccagtaaagaacaaagcagttatacatgatctcctgtcatgaaagtcatagctaagattcaacctgaactctaacgatttctccccaaactccacctttctgaagcttgtaatgaatatcccatcagaatctactggtagaagttcagttctaagaaataagccacaaccctaattctatttttttgtttctgtgtacttttttttgtttatatacatttttgggacagggtctggctgtcacccaggctggagtgcagtggaatgatcttggcttcttggctcactgcaacctctgccttccaggctcttaagccatcctcccacctcagcctcctgagtagctggaactacaggtgtgtgctaccacatccggctaatttttatatttttggaagagacaggtttttgccatgttgcccaggctcaaacgatctgcccatcttgtcctcccgaagtgctaggattacaggtgtgagccacccaacccagccccaaattctatttttgtaagtctgaatttaccccccacccccaacttatgacaaagaagaaaaataaattttaaaaaaacctcttagctgtaacttactatggttctaaaaattgtccctggcttccttccttttcactccagtgaatgctgattttacctcctttgatctggtaagctcaggcagagaattatgtcaccagtctttttacactacctccggaataactgaagtgtgctattcaagccgcccaggcgttaagaaaaaaccacatgggaaaggtctttcccaatttagtaaatgctgaaaaaaagcaagctacagagacaaacttcccttggatgcaaattaaaaacaaagctggggcccggtgtggtggctctggctcacgccttgaatcccagcactttgggaagctgaggcacgtgcatcacctgaggtcaggagtttgagccgagtgtggtggctcaggcctgtaatcccagctactctggtggctgaggcaggagaattgcttgaacccgggaggcaggggctgcagtgagccaagatggtgccacttcattccagcctgggcaacacaatgagactgtctccaaaaaaaaaaaaaaaaaaaaaaaaaaaaaaacaaaaaaacaatgcccacagcccagggctctgccacagcagaatgctgctgccgccacaatggcactcacctgatgcttactgtgagatagattagggaggttctcacttaatagtgctaccctacgaatagcaactgtttcaagctcagggaatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatgtacaatacatttggccaaatacctgactgtacactaaggcctgaactaaatagaacaaaatcttgaattcttacataaatgccaaagtacaatgaacattcaagaggcattaaccaggccacacaaatatctgaaaggaaaacctggggagatggcacagagaacagtcatgtggaataggatcctgggtggagagttcagagtaaacctgggactgtttcaaatagccaaggaatctagacaggaggggtgaattagaaaaaccaaccaaggccttacttaattagcacaatcccactgtggttacacatgagcaacaagtgtgagcatcactctgaatactcaattaactgattttctgagctggaaattgagaggaaaaaaactacctaactccatttctgcccgtcaaaaaaaaaaaaaaaaaaaagagaggagagaacagtggcagcactaataggaactgggctattagggaaaagtgacttaaataaaagtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaaagactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacatcaactattagtaagatcaaaacagatacttttgagtcctcacatctcaacctaagtatttttcttccacatgaattcttgataactcctatgaaatatctgcttgtctggcttaattttcacatgtccatttgtgagatctctgcaaacaaagataaagcttcaaggtctgcgacttcatttgatcataactgactccagctttggcgtattttctgataagagcttccttccttctgctaagttaacactggcaaatacagcctttaaaaatacctcaaatcattaactgaatgtgattgcagaggctataccaacgactctactgatcttaggcttatctgtcaaggtcaggcaggcccaagaacaggaataaacagagccaggcctaagaagtagccatggtctctggaggagacataggacagctcacaggacaggtctaaggtgcctttcccagagctcaaaaactgccacatttcctaagattccatttcctaaagtcacaaaccctgacttctagcactgctcaaatgaatatgctgacagttccattttcgctcacaagcccagcaaactcagtgagcctgtgaactccacatgggatacccttggaattcgaataggaggacccaagggggatgtaatcaagtaaatggagctcatttgtgcaccacagttaaagctgcaatggatgctaccagctgctttagctgcttttcgttcctctgaataattatcttctcttttcgtccctttccccatgtagaggtaatacccccgactatacctgtcttcctttctggttagtatagaaacatattttttgtttcagaatgtgatgaagacaaaaagaagaaaaccactaggttatgagtgactgcaaccacagcatatcaaacatccgaggttcactagcagccattttgcccagacatttcgccctaggaagggattcaagcaaaactccaatcacttgacatgacagtcctaaccaccaaataagcaaataatgcaatgttgtatttgggccttaaagaactgtctaaaagagagtattggcaaaacccctcagcatccaggccatcattaactcaatgtcccccaggcgcaagttaaatgaactttctcatattatagcatataaccctccagatgagacaaacatgggtagaaacttgtgaaatgactagagcttctaagtcagcatttgtactctcactcgggaagcatcaagtgtgaccaaaagttcagcattccttctgcttagtcaacaaacccactccacagtgctacagaacttgctaaataattgccaggctccactcttcccctctcacttgcctctgcctccatccccccttaagcttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggatgccaaggtaggcagatcacttgaggtcaggagatcgagaccagcctgaccaacatggtgaaaccccgtctctactaaaaatacaaaaagtggccaggcacggtggctcacgcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcctggcatggtggcgtgcgcctgtaatcccagctactcaggaggctgaggcagaagaactgcttgaactcgggaggaggaggttgcagtgagccaagatcgcaccactgcacttcagcctgggcaacagagcgagtctccaaaaaaaaaaaaaaaaactacacataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggcacttccctaaaaggagaaaagtagttacggaatccctgtgcatttcctcacctattcatcagcttcccagctggggcacatcagacactggctgcaggacaaccctgcagctgttgagctcctgcccaccagtcttcataaactcacttttggtccaaatttcacttacgactctaccagcaaagctgcctcttcaaaaggtttaatggcttacagagggcaaagggcacctggatgactgaacaacacaaaaggcaagattctaaaactcagaacccaccaggagaacagaaaaaatacagttttttctaagtggttatggtgactgcagactcagtgccaaaatgaaaaagacacagtccaaagaagtgaaactccacaatctctgatctgttagattggggctagttgaacagtcatttaaatctaatagtcatttgtatacaatgtaagacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgttttgttatgtttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaatattaaagattcacatgatacatatttaggaaacacatgctactttgttactgtttgaactctcaggaaacaatgttcccattggtgctccgaattgttactattctctgccatcctgaagataactaatacgtacctatctgtgttcaatctcagctttagattatggcactggtgtgtgagaaacaactggttcaactaactataagcaatatattaactctgcttttttttttttttttttgagacggagtctcactctgttgcccaggctggagtgcagtggcacagtctcagctcaccgcgacctccacccccggggttcaattctcccagatactcctgcctcagcctcctgagtagctgggattacaggcgcccaccaccccacccagctaatttttgtatttttagtagagacagggtttcaccatgttggtcaggctggtctctaactcctgacctcgtgatctgcccgcctcagcctcccaaagtcctgggattataggcgtgagccaccgcgcccagcccaactctgcttttacaggtattggctctcattccctagccattggttctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaagtgatcagattttcaccactcatctttgtgagatgggtctcagagggccccgtccctgctgacaccaaccattcttaccggtagcctgccaacacacaagcagttcacagtagaacactgcagactgcagggcattttcaggctacatagcctcaagttcctagaacaggaactgaggcttggaagaaggtcagtgcagcgcactcagcgaatggataaactgaatcatcatttcacaaggctgcaagcccatgtactaatggaatcaacatggaaccagagttaaattactgccttaaatatctaatgcatgtcaagaaatccatctaattactaagtaccgaaattataatactttcaaatgaattcacaaagcaaaacagctgaactaatgatctgtaaggatctcctggcagataaatcctactgggaatcaatacaccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggccgagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatctcagtttgaaatacaaatggcagcatggagagcaggctgcccgctttttggttggacatttctttcactcttgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgacaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaagaccctgataataaagacagaaaaatgctgaaacagcagaattttaaaccaagttcccctctgcagcacaagaaactcaggtaagtttccagtgtccaaagcctacactcacaaacacaaacacgaagccctccctttgcaaccctcaagtacccagaacctgctgaagaaaaccatctttcaccaccttttgttaaggttcctcagtattagtggaaaagctttattctcacaaagatatccaacaatgctaatttttacatggcatgttatttccttaggcaagattaatagaaaacctgaaaaattcgcaacaagcacacaaagactagcttctgtaacacaacctgaccccacccatatcacaccattttagaaggaagtccgtttaaaccagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttttagagtattcacaaatggggatcttaagacaccgagtacaagttactgaactagaactaaggcgtgggaagcttgatacgtcatacttcctcaacttagaaaatagttgcaagggtagcataaagcttcagtccacaaagtttgtaagtttggacttgctatggtattggtcaaagttcaggattgttcctatactaaccaactgcactccattctagctaatggagaacaaaaatacccctagaggcagcttccacaccagttaaacacgaaaccagagcagcagtacttagtctacaaacactcctgagtaggtaagaggacagatatcattcaccaaagtccctgtaaccaagcagtaagttaaggccaagttgttactgtcaaggaaggagaaccccctagttaaaaatagcactaggctgcgaaggtcgagttcaaataccagcctggccaacatggtgaaacccggtctccacaaaaatacaaaaattagccgggcatggcggtgagcgactgtaatcccagctacttgagaggctgaggcaggagaatcgcttgaacccagaaagcggaagttgcagtgagctgagatcgagccattgcgctccagcctggacgacagagcgagactccgtctcaaaaaaaaaaaaaaaatcaaaaaccagtaaatagaggaccagttaggaaccaaattaaccatgcatctcttcccctgaactattttctgaggaagaaggcaaaccccaacaccctcggctaaagaatgtaacaaaatgccagtgtctggctaccagacacgactgacacagtattccctttcagttttgctgaattggccaaaatgagtattgggctagaattcaaaatcctgaagaatcaagtatgtccccctaccttagtgagtcttaattaactccatccttagggagaattccaaaccaaagtaaattatcaggagggcatttaaacaatttaagtaacacacatttcaggtaacacacaaaacatttcagttgactaccgaaattgtattatggcaaaaagttgcccaagacttagtttcccattatttcatacttgccccaaactccctttcagttaaccataacaccatctaggccagaccacagcaggttatcagcatcagcagagatcagaaaacaaaaataaagccacgcgtcagggtaattatttatttttattgtctctttattcctgtaatgtaaaaaggaaaacaatgtcatgtaactctcttcgctacagatacggacagtttctgtagcctctaaaacaggcaggaaatggccttcataaccattctccaattttgctggaggatcagggtggtggaagtcattttaaaaaccagctgcaatatactgtactaccagagagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtctccagagatcatctctccaagtccgctcggcaccggcgcctgagctggggctaaggtcccgcgtctctggttctgtcctaatagaatccgggacatccacagggattccccggggcagccttcagtgaagaccagggagaggggccgcccgggtctcacgggtgcttcccgcgctggggatggcggcgagcagccacggcctatggacgcgcaagggaaagaatgcagcgaccccggagctcgcagggccgcccgcccaggagtctgaggctgggaggacctcaccttgctgcggtcctcctcctgctgctgcagcaactcgggaaccgcggccatggcgacgcgggactcgagcaggggccgcctggctgtgcgaggaaagaagaagctgggccgccgccgccgccgcctgggcgcctctcgggggcggccacggccccgcctccgccggcctccctgcccgacggcggcaggaggcctccggactccgccaccatcccagctgccccgggagcaggcgagcagggcgccacgtgctcccccagagcagcctcccagtccccgctgccgtccatcttggagccgggcaaagacgccacgtggggcctacccttgctccgctccacgaggaggccgccaaccgcagggccgcgacacggacgggaagcaacggacactctcccagcaagacgcgtctagagaaagaccgcgtttcggtgcggggggaatttattactcagcccgagtccaagatggcagcgagcgctgacgtcaccagatctcgtgagagcagaagggcgcgatttggaggctcccgcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaaacataatcagaggttcttcataaggatctgaggataaatacactttaaccttcaacttctaatttactaacttggacaagtgaggagaatagcttccttaaatttaatattccattcaaaaacaaagaccattggcactggtgaattagctagtcccataaattatataggggtcttttgttaaaggaaagtttcacatcaatcattcctttacccaagcttcccaaagtgcagtacatgtactcttagtagtacacaaactctttcatttttgttttaagaatagtgtactgacccttgccatagcctgggcttctatttaagtcgtcttttccctaatccagactcctaaaactatgcgtgtaacacattaaacatgtcacatgttctaaagaaaaatactaagtatatataggtggtattggatatgtaccaaatggtcaaggcctttgctccttataatattcctcagctgtgtggggcaaggattatatatgcaagagctaactgccttcctaagatagttaattagtagcaaccaccaaactattgtctgctttccaagcaagcaacataaaaatcttctaatggcatcttacagttttgtatttgtaccactaaaatttagaattgatagttttctcatgagaagttattttccttaaaccaggaatgtacagctgaaattactaataagaaatgtattattaaaaggcagaaacctgctggaacacatgggaccccagggcctgtagctcttggcacaaagtaaggaagtgcaccagagaggaatttctgtttggaatgtgaatgagccccaatagcccaggcagagagaagactggttgttttttttttcatagagtcagctttgttgatctagattagcactcagctgtgtttctcagttaactcagtagcaaccttaagaaatgagcagaatcgcttaccccagcaccccgcccagacttgaccgccgggacccaagtgattctcccatctcagcctgctgagtagctgggaccacaggcgtgcaccaccatgcctggctaatttttttattttttgtagcgacaagggtctccctatgttgcccaggctagtctccaactcctgtcttcaagtggtgctcccacctcggcctcccagaatactgagactacaggtgtgacccactgtgcccaggcagaatcactctttttagaaaataagtattagtaagcagtgggttctgaaataaataaagggacaattagtgtcatggtgaataaaagaaaaagggctcactaaattgattaacgggtctggaggatactggatcccaaacccaagaaggtggcacccaagaagaattacattttaaaaattaagaagatttttttaatgaaaaatattggatcagtaatttctacccagtcttctcaaaggtgagagcatagaaatgtgtctggcattcttccaaatacttgagcagtttcccaagcatcagttcatcttttgaagactggtgggaatgagaaagtctgacttattctgatttatattttgtgtataaatacacacaaagggatggggtttaggttttaatttttttttttttttttttgctacgctgatttaatcctgaagtattagccatcctgccagttccatcatgagaatactggagatgcatgaaggttttttttagtgcacttcatatacgaggacttgaaaacatttcactttcattactttgagtgaataagcagacttgatgctacatgcagtgaatattcttggatcattttttatttttataaattgaatcatgttgaatgttctgagccttagtgtctaaaggatcctgtaatctaggttttcatgtttgtgatcatgtgtatatgaagaacctagccaggggtaagtttgcagcgagaaatgtatggtctattggcatggcatttgctaagtttttttcttcctgtttttaacatgtttgtcttctgcttcattaacctagtgtgtagatgaatgctatacacttctttttcctaggctttaattccatcagtcataaatttcttgtaggtctttcacgtgttaataattccaattgagtcaagtaaatttggagtagaataacttagttcctaagttgaatttcatttaactctccaaataatttttcagaagggattccattttttgctaatgatagaattgacatttccagctgggcatagtggctcatgcctgtaatcctagcactttgggaggccgaagcaggcggatcacttgaggtcaggagttcaaaaccagcctggccaaaatggcgaaaccccatctctactaaaaatacaaaaaaattagccgggcgcagcgatcacttgtaatcccagctactacggaggctgaggcaggagaatcgcttgaacctgggaggtggagattgcagtgagccgagatcataccactgcactccagcctggaaaaaaaaagaattgacatttccatctttgtaaaaaatagttgaaggccgagtgcagtggctcatgcctgtaatcccagcactctgggagaccaaggtgggacgattgcttgaggccaggtgtttaagaccagcctaggcaacgtagagagattgcatctctacaaaaaaaaaatttttttgaattagccaggcgtggtggcacatgcctgtagaggaagctgagacaggaggattgcttaaggccaggtgttcaaggttacagtgagcaatgatcgagccagtacactccatcctgggtgacaagtaagaccctgtctcaaaaaaaaaaaaacttgacaaatgtaaagttgttttccgccttttctgtgggtctctctgcaagcatgttccaagcacgtgtatttcctgctctgtttctctgagtatctaattggtgatttccaagattgcttcctttgctctactgtgtggtagattggaaacagattctggtgccaggctgcctgtccagctttttgctttggggcaaattaacagcactgcctggtgggatagggcctcattcattaaaatgggggtaacttacaatccctattttgctgggttgttgggtttgaaaattaaataatgttttgaaagctccaaggccattgcttagcataacagtcccccctctttctctcctcttactaagaaacaagtgaatatatttcttgtgtttgttgagtctctttgtgtgtttttttttttttttttttttttgagattgtcttgctctgtcacccaggctggagtgcagtggcatgatcttggctcactgcaacctctgcctcctgggttcaagcaattctcctgcctcagcctccagagtagctggaattacaggcatgcgccaccacacctggctaatttttgtattttgagtagagactgggttttaccatgttggccaggctggtcttgaactcctgacctcaggtaatccgcctgccttggctgcccaaagtgctgggattataggcataagccaccatgcccggccatgttcccttttttaaaatgtgtatgaggagggggcttactatgcaagcgcttggaggccaacgagcactgaaaatgaggagagagttcaaaaatcaagttagatcctgggatacgccaacaaatccagacactacagttctttcggagaaacctggggacgaaaagtaaggctttgacctcagaaaatgaacatacaggaaaaataatgtgtcctaatgtgtcctaatgaaatttctctagtattcacatgttataaaatgttaggaagaaagaagatgtgtcctcctacaagccataaatcagaattctaataatctaaagctaattagaaaaatattacatgttaaatattaaatattagaatagaaaaatgtatgagggaaaaaaattgagacacagctgaatttttcaggctgttccagcactaaaaaaaaaatacaggagaagaatgtcacatattttcctcttcctccccctccagattccataatatcaaattcataacttttcatttgcgcatgccttattttccattccttgtttgtcactaatcctgttagtaaaaggattcccccacctatgttcataattaagttttggtctaaaaagaactacaaacagaagcacagttccctagatttctaatttttttttattttatcacagccagttaacttattacattggatacttaaacacatagtaccataaactggatgtggtcttgtagccgccagatcttcagttttgactttggcccaattctcctagaagtacttaattttaattcattttattacctaacgtcctattaataatcccgttggtttcaaagtatattcttaggtttcacaagaggctgaaatttggtcttaggggttgtcacttaaaaataactaatgtaatttttggccgggcacggtggctcatgcctgtagtctcagcactttgggaggccaaggctggcagatcacgaggtcaggagttcgagaccagcctcaccaatatggtgaaaccccatctctactaaaagtagaaaaattagccaggcacggtggcgggcgcctgtaatcccagctactcaggaggctgaggcaggagaatcacttgaccccaggaggcagaggttgcagtgagccaatatcgcccactacactccagcctgggcgacagagggagactccatccaaaaaaaaaaaaaagaaaaaaaaatgtcatttttaattgtattgtttcagggcgttttagagtatttgtttttcagtgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagtaagtatgagattggaggtgaattaatacagcgtaggacagatggtgcctgtcaaaggtgtgcctgtaggtactgtagcctctgtctgtttaatgtccagacctttgtgctaggtaaaagaattgggtggggcggggttgagaacaggtacaaggagaagagccacgtaacctttgtcatccagtactccaaaatcaaattgtttgctggagaaaggtatattctttgtttgtttgttttgttttgagacggagtgtcacccaagctggagtgcagtggtgcaatcttggctcactgcaacctccgtctcccaggttcaagcggttctcctgcctcagcctcctgagtagctgggactacaggcatgcaccaccgcacctggctaatttttgtatttttagtagagacagggtttcaccatgttggccaggctggtctcaaactcccgacctcaagtgatccatccaccttggtttcccaaagtgctgggattacaggcgtgagccactgcacctggccgagatttttcaatctccctaacatggcctgtttgccagcctgtccttcccctcccccaaagcaaggtacctgccataagatccaatttcattcctgcgttttctttcctgtttttctaaagatagcaccatgatctgttggttctgaaaatcaactcttcctggcttccaggcagtgcttgacatggatcagagatctgaacttactaaagcttcccatggttgttttgttttgttttgtttcgttttgttttttgagacggagttttgctcttgttgcccaggctggagtgcagtggtgcgatttcagctcactgcaacctccatctcctaggttcaagctattatcttgcctcagcctcccaagtagctgggattacaggcatgcgccaccatgtgtggctgattttgtatttttagtagagatggggtttctccatgttggtcaggctggtctcgaacttcggacctcaggtgatccgcctgcctcagcctcccaaagtgctaggattgtaggcatgagccaccacgcccggtccccatggtttttatatcgtagctgtcttactgttttactcaggtacttcagagtccaagtgttacaggaaaggggtcctgatccagaccccgagagggttcttcgatctcgggcaagaaagaatttaggttgaaggcaggcacagtggctcacgcctgtaatcccagcactttgggaggccgaggtgggcagatcacctgaggtcaggagttcaagaccagcctagccaacatggcaaaactccgtctctactaaaaatacaaaaattagccaggcgcagtggtgtgtgcctatagtcccagctactcgggagtctgaggcaggagaatcactttaacccgggaggcagaagttgcagtgaaccgagatggtgccactgcactccagcctgagcaacaggtgagactctgtctcaaaaaaaaaaaaataaaagaaagaaaagaaaaagcattcaggatgagtctgcagtgcaaagtaaaagcaggtttattaataaagtaaagtagtggaagtatagctactccatagacagagcagggcgttcctgaaagtaagaggaggaacacttccaccctaagtacagtgctcatatatataagataaaaaaagagatcttggggagatgtgctctactgcaagggtttgtgataaaggattaattttcttaattattatattttgcaagaatcgatactatctttaaagcaaaattaggaatgccttcgttctccagatatcagggtatctggacactcccaagtctgggtctgtttagtaaacattattaatttgttcccttaaccttaaacatctagaggctatgaatgcctgactttctgggaatgcagcccagcaaggcccagcctcactttcctagccctcactcaagatggagttgctctcgttcgaacgcctctgatacaaaggtggctacaacctgcaggtacccctaatccaaataaggcaagcgatcactaagaacaagatagaaaaatccgttcatgtaaaccttgaagctctagttaaaatttaagtttaaaagcttgtctattccacagcccaatacaaattcgtaaactttcttaaaacattatgagatttttttttggttatttatttatttatttttagttcatcagctattgtgtggcccaagacaattcttccaatgtgggccaggaagccgaaagagtgggcacccttgatagtctgaaaactgtttagaccacctaatggttttattttttatttatttatttttgagacggagtttcactcttgttgcccaggttggagtgcaatggcgtgatcttggctcactgtaacctctgcctcctgggttcaagcgattctcctgcctcagcctcccaagtagctgggattagaggtgcacgccaccacacccggctaatttttgtgttattagtagagatggggtttcgccatgttggccaggctggtctcgaactcctgacctcaggtgatccacccacctcagcctcccaaagtgctgagattacagacgtgagccaccgcgcctggcctagaccacctaatggttttatagcacaactgcgtcatatctgagaagagccctgtataccaagagatttaatagactttggttgccttttagataaaccaaggaagccatacagtcacctccacccaaggcctacaagaagttcctgacacccaatgcttgtcatagagatgataaaatatgtccatagcactgttgtttgttttttgctttttaagtcaacatcaaccttggtaatatgaacatttttgaaactacggtttttttttgttgtttttgtttttgtttttgagacagagtcttgctctgtcacccagactggagtgtggtggcccaatctcagttcactgcaacctctgcctcctgggttcaagcaattctcctgtgtcagcctccccaagtggctaggactacaggcacccaccaccacgcctggctaattttttgtgtttttagtagagatggggtttggacatgttgcccaggctggtctcgagctccgggccttgagtgatctgcccgcctcagcctcccaaagtgctgggattgtaagtgtgagccactgcacccagcctagaattttttttttttaagacacagttttgttcagttgcccaagctggagtgcggtggcatgatctcggctcactgcaacgtccacctcgcaggcccaagcgattctcccacctcagcctcctgagtagttgggaccacagatgcgaacaaccacgcccagctaatttttttgtatgttttgtagagatggggttttgccatgttgctcaggctgatctagaattcctgaactcaagcaagctgcctgtctccgtctcccaaagtgctgggatttacaggtgtgaggcaccgcgcccagctaagaattttttatttttgttatttttttaattttatttatttatttttttgagatggagtcttgctctgtcacccaggctggagtgcagtggcgcgatctcggctcactgcacgctccgcctcgggttcacgccattctcctacctcagcctccccagcagctgggactacaggcgcatgccaccacgcccggctaatttttttttttttgtatttttagtagagacagggtttcaccgtgttagccacaatggtctcgatctcctgacctcgtgatctgcccgcctcggcctcccaaagtgctgggattacaggtgtgagccaccgcaccgggcctaataattttttattttattttagtttatttttttgaggcagtctttcactgtcacccatgctggagtgcagtgatgcattcagggctcactgcagtctctaactccccaggctcaggctgtccttccacctcagcttcccaaatagctggaactacagggatgcaccaccacacccaactaatttttctattttttgtagatgtggggtctcaccattttgctcaggctggtcttgaactcctgggctcaagtgatccaccacctcagcctctcaaagtgttggaattacaaacgtgagcccctatgcctggccgattttgtttttgagaaggagttttgctgttgtcgcccaggctggagtacaatggcgagatcttggctcactacaacctctgcttcccgggttcaagtgattctcctgcctcagcctctctagtagctgggattacaggcgcctgctaccatacccagctcatttttgtatttttcatagagacggggtttcaccatgttggccaggctggtctcaagctcctgacctcaggagatctgcctgcctcggcctcccaaagtgctgggattacaggtgtgagccactgtgcccgaccccactgaatttttaatgggtaatatgctattaagagtaactccccacacccactctgtattgaacctctgtttaaaaagctcctgtgttcctgagatattgtatgaccatatgtacaatcatttgtccccacactcattttttaacacaagatgatataccctgcttttttccacttaaaaaaattatttaaaaaaaaatcaggctgggcgcagtggctcacacctgtaatcccagtactttgggaggccaaggcaggcagatcacgaggtcagaagattgagaccatcctggctaacacggtgaaaccccatctctactaaaaatacaaaaagttagccaggcatggtggcaggcgcctgtagtcccagctacttgggaggctgaggcaggagaatggcgtgaacccgggaggcggagctggcagtgagctgagatcacgccactgcactctagcatgggtgacagagtgagactccatctcaaaaaaaaaaaaaaaatcttttattagtttatatagatctgtaacattcttttctcatgtaataattttccaccacccacaattaacacttaacactggtgcatttgcttaaaactttttttttccttatccctgtgattacatggagatcttttttttaaagaaatataatattacagattaaccccaaattctgttgaaccacccgtggccaaaggcgattgctgttttaagtttggcactacctccttctagtctgccttctacgctcttttttgttcttttctttttttaatgaccaatgatctgtgacacagcatcaggagaacctaagaatatgtgccctctatactcttagcacacacataatgctatgtataatacacatgcataggcagcacttatgtatgatttcatgcagaactgtgacagtcataatatacagacatctctagatacacagcatcacaaagctagtaagatattgggctcaggagccagctgcttgagtttggattctggcttggcttttcatcttaaccttagattaattacttagtcgctctctgtctcaatttattcatctttaagataagacaaatggtagtacctaccttgttataaaatgagatattccctgaagagtgcttaatgcatactatgtattcagtagatgttacattattattttgatctacttctttttttacttttttatagaaataattcttgctgtgttgcccagactaatctagaactgggaaggaagtatgatcctcacctcagcctcccaaagtgctgggattacaggcgtgagccaccttgcccaatctactactcgtgtgtgtgtgtgtgtgtgtgtgtgtgtgtgtgtgtgtcagagtctcgctctattgcccaggctggagtgcagtggcacaatctggactcactataacctccgcctcccaggttccagcaattctgcctcgccctcctgagtagctgggattacaggtgcctggctaattttttttgtatttttaatagagacagggttttgccatgttggccaggcttgtttcgaactcctgacctaaggtgatccacccatctcagcctcccaaagtgctgggattacagacttgagccactgcacctggccctacttctctcttaactcgttttttgtattcttttgtatgaatgagccttacccatttccctattgggaacactcagattatttctagttttccacaattacaaacagtgctgcagcaaatgtgcctctttgtatattacagagctgttctaggcagatgcacagattcatttgtttatttattttttttcttgagacggagtttcacccttgttgcccaggctggagtgaaatggtgcggcaccgcaacttccacctcctgggttcaagcgattctcctgtcttgtactcccaagtggctgagattacaggcatgtgccaccatgctcagctaattttttgtttttagtggagacagggtttcaccatgttggccaggttggtctcgaactcctgacctcaggtgatccacccacctcagcctcccaaagtgctgggattacagacatgagccaccatgcctggcctgtttgttttagacgtgtgatatatgcagttacaatccatttagttggtctgaagtagacccggacatgactgcttcttaaatctcccaggcacttgtcacttcacttgtactcaggatatcaagccattgctatcctatactttaggaaggttgctgggtcaagggtatgcattttaaattaccaagaatatgagtgaatacatttaacaatacagtgttagtaattttgataacattgtatttttaatttgcatgtcacataagtgagactgagcatcttttcatttaagagctatttgtgaactgttactgtacttttaatttgggtttacgctactatgatgttaaaaaatgtttttgactgacaataattatatatatttataggctacagtatgatattttgatatatgtatacctaatggaaagattaaataagctaattatcatatccatcacttcacctatttatcattttttggtggtgagaatctttaaaatctactcttttagcaacttttaaatatacaatgcattattaaatatggtcaccatgctgtgcaacagatcactaaaatttattcttctgacctaactgaaacctcttaccctgggatcagcatctcccctttcctcttccccactctccatccctatcctcttgtaatcaccattctactctctctctttctgagttcgacttttttagattccacatataaatgaaatcatgcagtatttgtctttttgtgcccagcttatttcactcagcaaaatgttcaccatgttcacccatgtcacaaatgacagaatttccttctttttaaaggctatgtagtgttctattgtgtgtgtgtgtgtgtgtgtgtgtgtgtgtgtgtatccacattttctttatccatttatccatagatggacacttaggttgtttccgcatcttggcctttgtaaataatgcttcagtgaacctgggattgcaggtgtctcttcaacatactgattttaattcgtttggctatatatccaaaagtaggattcctggatcgtatagtagttctggtttcagtttttagatgttttagttttctgaggaacctccatgatgttttctcaaatggctatactaatttacatgcccaccaacagtttatcagggttctcttttctgcagtcctcaccaacacttaccttttgtctttttgataatagccattctaacaggcatgaggtaataatagcccagtgtgattttgatttgtctttcactaatgattagagatattgagcatattttcatctatctgttggtcattcatgtcttcttttaagaaatattcattgagctcctttgcccattttttaatcaagttatttgttttgttactatttagttgtttgagttccttatatactttggatattatccccttatcagataggtggtttgcaaatattttctcccattctgtggattgtgtcttcactgttgtttcctttgttatgcagaagctttttatttggatgtatatgtctgtttttgcttttgttacctgtgcttttgggcttctgagaaatcatggctcagatcagtgttggggagcttttctcctgttttttttctagtagttttacagtttcaggtcttaaattttaagttgatttttgtatgtggtatgagatagggtacaatttcattcttatgcaagtcgatacccagttttcctaacacaattgacaaaacattccccattgttcgttcttggtacctttattgaaaatcaattgactgtaaattcatggttttgtttctgggctatctgtcctgttccattggtttaaggtgtctgcttttatgctattatcatgctgtttgattataacagctttactttatacagccatgttccacataacaatatctcagtcaacgacagactacatgtaaacagtggtcccataagattataatggagctgaaaaactcctatcatctagtgatgttatgttatagtgcaacatactactcgtgttcgtggttatgctggtataaactaacctcctattcagtcatataaaaacagcacataccattatgtacactacagtatataattgataatggtaataaacaactattactggcataagctggtatataaccagcttataaacaactattactggcatattactggtatttactatgattctgaccctgtgtaggcctaggctaatgtgtatgtttgtgtcttagtttttaacaaaggtttaaggggtaaaaaataattttaataatagaaaaagcatgtagaataaagatatcaaaaaagaggccggggcatggtggctcacacctgtaatcccagcactttgggaaaccgagacaggtggaccacttgaggtcaggagttcgagaccagcctaggcaacacgatgaaactccgtctttgctacaaatgcaaaaaattacccgggtgtggtggcacatgcctgtaatcccagctagtctggaggctgaggtaggaagattgcttgaacccgggaggtgggggttgcagtgaaccaaggttgcaccactgcactccagcctgggtgacagagcaagactttgtctcaaaaaaaaaaaaaaaaaaaaagaaaaggaaaatatttctgtatagttgtacgatgtgtttgttttaagataagtattattacaagagtcaataaattaaagaagtggccgggcatggtggctcatgcctgtaatcccagcactttgggaggccaaggtgggtggatcacctgaggtcaggggtttgaaaccagcctggccaaaatggcaaaaccccatctctgctaaaaatacaaaattagccaagcgtggtggtgcatgcctgtaatcccagctatttgggaggctgaggcaggagaatcgcttgaacctgggaggtggaggttgcagtgagccaaaattgtgccattgcactccagcctgggcaacaagagtgaaacaccatctcaaaataattaaagaagtttatacagtaaaaaagttacagtaagctaaagttaatgtattattgaagaaagaaaaacgttttttataaatttagtgtagcgtaagtgtacagtgtttataaagtctatagtagtatacagtaatgtcccaggccctcacattcactcaccgctcactcactcaatcacccagagcaacttctagtcctgcaagctgcattcgtggtaggtgccctatacaagtatactgttttttatcttttataccacatttttactgtaccttttctgtgtttagatgcactaatgcttaccattgtgttatagttgccagcagtattcagtacagtaacatgctgtacaggtttgtagcctaggagcaaaggtctgggtgtgtagtaggctatcctacctaggtttgtgtaatatactctatgtttgcacaatgacaaaattgcctaaccatgcatttctcaggacatatccctgtcattaagctacacatgactgtactttgaaatcaggcagtgtgatgcctccgacttcattcttttcactcaagattgctttggctattcggagtcttttgtggttccgtgttaattttaggatttttttttttctatttctgtgaaaaatgatgttggaatttttttttctttttgagacagagtttcacccttgtcgcccaggctgcagtgcaatggcacagtctcagctcactgcaacttctgcctcccaggttcaagtaattctcctgcctcagcctcccgagtagctgggattacaggggcacatcaccacgcctggctaatttttgtatttttagtagagacgaggtttcaccatgttggccaggctggtctggagctcctgacctcaggtgatctgcccaccttggcctcccaaagtgctgggattacaggtgtaagccaccgtgcccggcagaattttttttttttcttttttcctgagacagggtctggctttgttacccacgctgttgtgcagtggtgcaatctcggctcactgcaaactccacctcctgggctcagcctcctgagtagctgggacaacaggctccagccacaacacctggctgattttttggtattttttatagagacagggtttcaccatgttgcccaggctggtctcgggctcctgagctcaagcagtccacctgccttggcctcccaaagtgctggagattacaggtgtgagccatcacacctggcctgccattggaattatgataaagattgcgtggaacctatagattgctttggatagtatggacattttaacaatattcttccagtccataaacagaggatatcttaccatttatttgtatcattttcagtttctttcatcaatattttatagttttcagaatgctattaaggtttttttttttacatttattaagttctacaattacagtacattgctgcaaacagtgttctgtggcagaaatataacatggtggctcacacctgtaatcccagcagtttgggaggccaaggcgggtggatcacttgaggttaggagttgaaaccagcctggccaatagggcgaaaccccatctctactaaaaatacaaaaattagctgggcgaggtggcgcacacatgtaatgccagctactcagggggctgaggcagaagaatagcttgaacccaggaggcggaggttgtggtaagccgagattacaccactgcactccagcctgagtgagactccatctaaaaaaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagggagaaaaagtgggggggtgcacttatagtcccagctacttgggaggctgaggtgggaggatcacttgagcccaggagtatgcgtttagcctgggcaacatatgaaaccccatctcttttttaaaaaaggaaaaaaatggtgaataagagcaatggtcattggctgacaagtaacaaactatacataagagaactgttaacctagtagagattttcattgtgatctattacctacaaagtcttcctgtggtttctctttaggggcaagctctgtgtgattgattggaagacatcagagaaaccaaagccttttattcaaagtacatttgacaacccactgcaagttgtggcatacatgggtgccatgaaccatgataccaactacagctttcaggtcaggacactgagcctttacttaaagctttgctcaatgcttacttaaaactataactccgggccgggcgcagtggctcatgcctgtaatcctagcactttgggaggccaaggccggtggatcacttgaggtcaggagttcaagaccagcctggccaatatggtgaaaccctgtctttaccaaaaatacaaaaactagctgggcatggtggctcatgcctgtaatcccagctattctagtagctgaggcaggagaattgcttgaacccgcgaggtggaggttgtagtgagccaagattgcgccactacactccagcctgggcaagagagtgagactccatctcgaatctgtctcaaaaaaaaaaaaaaaaacttctcagtgggggggtaggaggagaaaaattgtaaaaaaaaaaaaagttaaaaaatagaactccttgaggtttttccttttttaatctctatttttatcccattgcttaacgtcttccttgttcctttcccacttaaaaaagcactttttggctgggcacagtggctcacgcactttgggaggccgaggcaggcagattgcttgtgctcaggagtttgagtccagcctgggcaacatagtgaaaccccgtatctacaaaaaaaatacaaaaattagctggacatggtggcgcacacttgtgccagctacttgggaggctgaggtgggaggattgcttgagcccaggaagtggaggttccagtgagccgagattgtaccactgcactctagcctggccgacagagcaaaaccctgtctcaaaaataaataaataggccaggtgtggtggcccaagcctataattccagcactttgggaggccgagttgggcagatcacctgatgtcaggagttcaagaccagcttggctgacatggcgaaaccctgtctctactaaaaatacaaaaattagctgggcgtggtggtgtgtgcctctagtcccacctacttgggaggctgaggcaggagaatcgcttgaacccaggaggcggaggttgcggtgagccaaggttgttccactgcactccagcctgggcaacagagcaagactgtctctctccaaataaataaataaataaataaataaataaatagcactttttggccaggggtggtggctcatgcctgtaatcccagcactttgaaggaggccgaggtgggcagattgcttgagcccaggagttcaagaccagcctgggcaacgtgacaaaactccatcattactaaaaatagaaaaatcagccggaagtggtgcccgcctcagcttcgagggtgcaacgagccgagattgtgccactgcactccagcctggacgatgggagtgggatcctgtctcaaaaaagaaaaaaaaagcacttttccaccctcttcttgggccttttttttttttcaatggctctgtaaggatcacagcccagtcttcaatgttttatctgtcatctttgtgttcttgtgtcctggtgcagtctttgatcaacctaccttagaaactgagttaggagatatcctgtagattattttatactgagtttgccctggagtaagaaggaaacgaacctaaactctggacctactgtagtgaaacgagaattgccctgtgtttcttcctaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaagctttggttttgtttactttgtgtgtttataggataattttataaacctggaaattgtttgcactttttttataattcagaattttacaagcccaatagctttggtgagagttctgtgtaagtgcataaaagaaagcgtcctcggctgggcgcagtggctcacgcctgaaatcccagcactttgggaggccgaggcgggcggatcacaaggtcaggagatcgagaccatcctgggtaacacggtgaaaccccgtctctactaaaaatacaaaaaattagctgggcgtcgtggcgggcgcctgtagtcccaggtgctccggaggctgaggcaggagaatggcgtatacccggaaggcggagcttgcagtgagccgagatcacgccactgcactccagcctgggcgacagagcgagactccgtttaaaaaaaaaaaaaaaaaaaagcctcctcactaagccctcagccacggtcacctagcaaggaaagcaatattcaggtaggagatgggaggatcaagggggacctttgtattatctctatacacttctgcattcatgtgggtttttctcaagctgcagatacatatttctgtagcctgtaaattccagtcaaaaatgaagtgaggcaattaaaagttgtgctagcagagtttgccactctgctctaataagcctcaacctagaatttaggaggctagacctaacaaaatttctttttatttttctttttttttttttttgagaccatctggctctgtcagccaggctggagtgcggtgggctcactgcagcctccgccttccgggctcaagcaattctcctgcctcagcttcccaagtagctgggattacaggcgtgcaccaccatgccctgctaatttttgtatttttagtagagacagggcttcgtcatgttgaccagggtagtctcaaactcctgacctcaggtgatccgcctgcctcagcctcccgaagtgctgggattacaggcgtgagtcactatgtccagctgcaaaatttcattttaatacaggtgttctgttatgtaaatagaaatttgtctcagacctgtgactttgtactaggagtctcccaagataatggtggcctgaaaagttctatgagggagcccctcaggagagtgtgaccaggaggatgtggttggtataagaacagagaaggtaaatccctgggcaggttttcttgacctcaagggctcaccagtttctcctgataatcatgatactcctcgggggtcacatctcctgagatgttaatgtcaacggaaaaagttattgttactacgaaagcataggaggagaaagtcaaatttgagtttctaaatgagttgcagtttttcaagaattaacatgtatgaggcagtggcttacgcctgtaatctcagcactttgggaggccgaggcgggtgaatcacttgaggtcaggagttcaggaccagcctggccaacatggtgaaaccctgcttctctactaaaaattaaactagctgggcctggtggtgcacacctgtagtcccatctgcttggggaactaagacgggagaattgtttgaacccaggaggcagaggtcgcagtgagctaaggccacgccactgcactccagcctgggcagcagagcgagtctccgtctcaaaaaaaaaaaaaaaaaaaaaggaattaacacgtatgttaggaattgttggttgccatctctttgccgaagtgaaatactgcatatgaaactccagtgaaatgaaacagcattcaaaataaggagagacgctcaaggataatttacatttttttaaaggaggtgtgtgtatattgcttttctgaggaggctttctcagaagtacagaatgttgccttccagtgtttagttttgagaaaatccgttggcttcaaagctaactgcatttccttttcctccacagttctacccattcttaccaatgcagtcagcaactgacagaagttccatgctgacacaaaagccaattttgttttttccaaaaaaaaaaaaaaaaaagtataaatatatacacatacatgtatggcctttttcctccttacacctggcctcttcctcagagcctgataatctgagaacattagcctctataaccctattataattctaggaaaactcgtcagtgtatgacctacggtttcatatgtgttgaccttggtaaatacaggaagggggttagtcataagtcagtgtgttcctaggtaaccaatttggctactggctttaaaaggaattggagaagggtactttgttttaatcactgaggctttccacccgagcaattaaatatttgattataacctaccctgtgttcctgcccacccctcaacaaaagagtgaaggaagggaatcattggagtaaaaaacattaagaaacaaaatagagaatagttgaaacttccatgtttaaagaaacaataagttgtttggagctatgtgttaaatcactcaatgctaagtaaaaagtagaactgacttttccttcctgcctcccttcccgccagcagaggcctaaaagttaagcagatatgtgcttctgctggaagtctaacctactgatccacttcagttatttatactattgaagggaactagagagaatctctggggagagaccccagaatgagcaaaaggcttgtatgttgccatgacaataacaattgtcaggttgagtaatgcatttgtgaagatccaatcataaaaagatggccaggcacagtggctcatgactgtaatctcagcactttgggacgctgaggcaggcggatcatttgagctcaggagtttgagaccagcctgggcaacatggcaaaaccccatctctaccaaaaatacaaaaaagtagccaggtgtggtggcatgcacctgtggtcctagctacttgggaggctgagggaggatcgcttgagcctgggaggtggtggttgtagtgagccaagattgcaccactgcactccagcctcagcaacagaatgagaccctgtctcaaataaataaataaataatgttttgggttcagatttgagggttttttcccattttacttaagaaatagatataaaatatgtagattgttacaggccaggtgcaggggttcacaccttgaacccaatgctttgggaggccaaggctagaagatcgcttgaggccaggagctggagaccagcttaggcaacatagaaagactcccatctctaaaaagtaaaaagtcgtgtaatcccagcactttgggaggtcgaggcaggcggatcacgaggtcaggagatcgagaccttcctggctagcacagtgaaaccctgtctctactaaaaatacaaaaaattagccaggcgtggtggtgggtgcctatagtcccagctactcgggaggctgaggcaggagaatggcatgaacccgggaggcggagcttgcagtgagccaagatcacgccactgcactccagtctgggcgacagagcgagactttgtcttgggaaaaaaaaaaaaaagtcgttgggcatgggggtcatgctgatagtcctagctacttgggaggctgagacaagaggatcacttgagtccaggtgtccaaggctgcagagagctatgatcacaccactacactccagcctgggtgagaccttgtctctaaaacaaacaacaacaacaacaaaaaatagaccaggccagcgcggtgtctcatgcctgtaatcccagcactttgggagactgagacgggtggatcttctgaggtcaggagatcgagaccagcctggccaacatggtgaaaccccgtctctactaaaaatataaaaattagtcgggcgtggtggtgggcacctgtaattccagccatttgggaggctgaggcacgagaattgcttgaacccaggagacagaggttgcagtgagccaagaccatgccactccactccagcctgggcaacagagcgagcaagactcagtcttctaaaaaaaaaaaaaaaaaaaaaagcattacagataaaagctgttgccttgttttcttaatcccatttccctctcccctgagacaaatgccgtcataaatttgatgtgggtttttttgtatagttttactgtgtgtactggtttccatgtataatatagttttgctttctgtgtttttagatttacttgctttatctcaactttgtttttgagatgtctccaggttcaccaattctagatctttcataactgcttttaactcctctgcagttctccctcctgttttattgtcatgctaatggactgttcggttaacagtgttttgctactccagacgatgcagcagtgaacacctttgcacgtgttttctggtacacacaatacacatgcaatatagtggaaagtgcagtatggattgtgactctgccacttactagctctgtgaccttggactagttacttgacctttttttttttttttttttgagagggagtctcactctgtcgcccaggctggagtgcagtggcacgatctcggctcactgcaagctcggcctccagcgttcacgccattctcgtgcctcagcctcctgagtagctgggactataggcacccgccaccacgcccggctaattttttttgtatttttagtagagacggggtttcaccttgttagccaggatggtctcgatctcctgacctcgtgatccacccacctcggcctcccaaagtgctgggattacaggcgtgggccaccgcacccggcctgttacttgacctttttgtgcttgatttcctcatctgtaatttgggggaaaataatagtatctgcttcttgaaattgtgaggattgaatgagcgaagcattcagaaaagtgcctgacacatggtgggaacaaaatgttagccatcctcctatcaaatgatcagacctggatgtgtctctgctgggtcaaagcttgaacattaccaccaaatttcctctccaaaacagtgacatcgacttaatgtcccaccagtggtgtctgaaatttcctgatttctcgcatattctctaacacaagagttgtgagcccctcttctgacggtatgaaaaccattttttttttggaacagcattaacgcgtgaataaaatctgctttaaaacgcgactgtcatctagtggtgagagaagtacactgcaattatggggcagaagccaaaaatgggcggacctacatctatctccgggtaatttgggcattttagtcaccaacacaggtctgttttgaataaaatcaactacatgagtgttcttcctttacctctgtattttcaggcagcttgtacttctcactttttctactacaataatatagaagcctggctacacagcccagtgaggccccttgctaccaaatgcatctgggtcaccggttcggaaaagtggagtgagataaagtagaaatgaggctatttaccaaactggtaggaaactgcagctccaaccagggcgggcttcccacaggcagcactgattttccagcaggagagatggcaattcccacgttggtgcaggtcatacaggcactgcaggggactcagctcagtcggctcaccagagccccagttaatgcgtcccaatcagcctcagccattctctgcgaggacttctaaaaggattgaaaagtgtatgaaagtgttagatattaatcatcagagacatagatatagttttaaagatctgttagataacaaatattatctaacaggttaggtaacatgctacaattttgtgatgaacaaaaatgttcattaaaggtaatagtgtaaaaaagcaatgttgctgaaatgtaacctaatgtgtctttaagtaatagtatcactaaactaatggcatattaaaagttttttaaaaaaagaagccgtgtgcggtggcttgtgcatgtaatcccgacattttcggaggctgaggctggcagattgcttgagcccaggagttcaagaccagcttgggcaacatggcaaaatcctgtctctacaaaaaatacaaaaattagccaggcatggtggtgcacacctgtagtcaggcccagctactcaggaggctgaggtgggaagaccacttgtgcctgggaggcagaggctacagtgagccaagatcacaccacttcactccagcctgggggacagagggagaccctgtctcaaaaaaaaaaaaaagttaaaaaagaaaacaaattctaaagaacagcaagctaaggtcaactgtgattagaagcattcatttaggcaagtctagactgtcctactgcaccagtctcactcatttctaagctgttgtttgtgctgacacctttgcataaaataacttcccttcctccctttgttcagccatatcttgcctgagagcttgggcctgaaccgcaatcccactgatgatctgctcaagtcttacctgctccacaggaaacaaaatggtatagggcaggaagcaggagcctcagaattgggcagaggtgggttcaaatcctgctgtgcaatgctaagtcacttcagctctccatgcctttttcctcactagtaatttggggaagagtattaacctcagtgttcctggaaagattaacataggaaatgtgtgacaaatgctgaacgtggaataggcactgggcaaagatcaactacttcctccgtggaaccgactctacccttcactgaactcttgtggtgcctttgtttttaccacccactttgattcttgttcatattctacctttttctgttacttcactatttcagatgtacatgtaacaaacacagtgaaaccccgtctctactaaaaatacaaaaaattagccgggagtggtggcacatcctgtagtcccagctactcaggaggctgaggcaggagaatcgcttgaaccctggagggggaggttgcagggagcagagattgcaccactgcattccagccagggcggcagaacgagactccgtctcaaaacaaaaacaaacaaacaaacaaaaagacaaaaaaaactacttattttatatctatttcttaagtaaaatgaaaaacaaaaagaaaaaaactctcaaatctgaacccaaaacatctttttatttatttatttttttgagacagggtctcattctgtcgccaaggctggagtgcagtggcacaatcttggctcactacaacctctgcctcctggattcaagcgattctcttgcctcagcctcccgagtagctgggattacaggtcattaccaccgcacctggctaattttttgtatttttagtagagacggggttttttcatgttggctggctggtctcgaactcctgacctcaggtgatccatccaccttggcctcccaaagtgctgcgattataggcgtgagccaccatgtctggcccagaatagtgttttaagagagagatgagtaaagagacaaacaacagaggaaactgccatttcctagagcagcagaaaaagagctgggtatcagaatggctcaccagagaaatttggttagtgctggtcacccctttgataagaggctgtgggttgacttgtgagctcagtgatttgaaagttttgagtatatgaagaaaaaaaaaagaaatgaaagctttgtgtagaactaggggagtctcgcagtgaaacaagacttgcaaaataggattaatgaggcagtacagataaggatgcgatgctgaagaaagtcatgggattgtagttagacggtgtataaatcagagagctaaaaccaatagggcttgtagatataggtatatgacaggggatttattaggggaatgggctcacacaattatgggggctgagaagtcctacggtctgctgtctgcaggctggaaaaccagggaagctggtagcatggctccgtccaagttcaaaagcctcagaaccagagaacctgatagcactcagtctcaggccgaaagcctgagaatccaggaggccactggtgtcccagagtccaaaagctggagaagctggagttctgatgtccaagggcaggagaagaagggtgttccagctccagaaaacagagcaaatcctcctttcctttgcctttttgttatcctggccctcagctgatggacggtgccccctgacattgagtgaggatggatcttccttactcagtccactgattcaaatgccagtttcttccagaaacacctcacagacacctcaaaataatgcttcgccagctgtctgggtgtcattaatccagttacgctgacacctaagattgaccatcataggtggtaattcattcctttacccgacaaatgtcttattgaatattcatgtctgccttgtgctagttttttgcaaaatgcatggagctgacagtctagagaaagggcaaacaattaataagtgagaaagttagtatgaaaattacagattgacagtgccatgaagaaacagaggatcactgagccaggaggagaattgcaactttggattgtgtggtcagagagggctcctctgaggggcgacacataacatgatacttgaaggaggaaaggaggaaacgtggccagcactgcagagagccacaggaagaatattccagcagaaggatcagcatgttcaaaggccccagggtaggaaagaacagcatgttacaggagctataagaacacaggggtggccagaaggcagtggggaaaggaaaggaattgcaggctgcagaagtgggcgggggagccagatgatgtcaaactcaatatgccatggtaaggagtttagattttactctaagatggaaagacagggataagcaggggaataaagccattccattgccttttaagaagagcggggccaagtgcagtggctctcaccggtaatcccagcactttgggaggccaaggcaggagatcacttgagcccaggagttcgaaaccagcctgggcaacatagtgagacctccacctctatttttttttattttatcttatctattttattttatttattttgagatggagttttgctcttgtcgcctaggctggaatgcaatggcgccacttcgactcaccgcaacatctgcctcccaggttcgagtgattctcctgcctcagcctcccgagtagctgggattacaggtgcatgccaacgccaccatgcctggctaatttttgtatttttagtagagatggggtttcaccaggctggtctcgaactcctgacctcaaacgatccacctgcctcggcctcccaaagtgctgggattacaggcatgagccaccgtacctggcctaatttaattaaaattatttaaaagacgaagaagaagaaaaagaagaagaagaggaggaggaggaggcggcggcggcagcagcagcagcagaagcagatcagcattgtttggagagcagaatgcaggaggcaagtgctgaagcacagcctggctggactattatagacagagctattataataggagtcagcacactggctcatccaccaaatccggcttgctgcctgatacagtctttatacggtctgtgagcatagagttgtttttacatttttaaatgtttggaaaaaaaatcaaaagtagagtctttttatggcatatataatttttataaaattgtaaagattcgaattccagtgtctgtaagtcaaggtttcctggaacacagcatcacccatttgcttttgactctggctgctttccttctgtagctgcaggttaagtcggtaacagaggctgtatggcctgcaaagcctcaagtatttactatctggacttctatagagtaagtctgccgactctcagtctagatgatagaagaggtaggctggcctagagaaatggcagaggaggtgctgggaaggaagattcgagatgtattttgggagccttgcctgagggtttgaatgagatgagtgatgaagaagtataaatggaaggtaagttgtaggtttagggcatgtgtgttatttgctgacatgggaaaggctggagggagaaaatccaggtccagccccatcttttctcctcactaacactatcagttagctttgctgtgcaataaatcacccagcctgggcaacatggtgagactcgcttctagaaaaaacggaaaaaaacaaaataaaacaaactagctggttgtggtggcacatgcctgtggtcccagctacttgggaggctgagttgggaggatcgcttgagcctgggagatagaggttgcagtgagtcatgtttgtgccacagcactccagtctgggtgacagagtgagaccttgtctcaaaaacaagtaaataaaaatcacccccaaattcagtggtttacgacttatttctcatgattctgaggtcaagctgagcatttctggtctgtgctggctcaagtagggctagatgatttaggatgtcatcacttagatgtctgagggttggcctggtgtcagctggggccatggagatgcctgggcctggtgactctcatcctccagagggctaacctgggctctcattcacgcagcagtagcagaaggattccggacagcagcagaacaagccccagcacacagcatttcacaagcctcggcttgggccgtgctgactaatgtctcgtttgccaaagcaggtcatgtggccaaggcaagaccaaaggatagagaaataaattccacctcttgcagagaggagccaaaaactcacatggcaaagggctgtggaacaggaaagggaacaatgggcccatttttacaacccaccatgctaacagcatgacccaggcaagttatctaaagcttttgagcctcagtgtcctcgtctgtaaatgggtaaaataataactacttcatagggtattcataaagactagaaatagctggcacataacatagtagtagctgttttattgttatcatcataatgaaaaagttcagtccctgctgggcaaactcatatttcccaaactccagtcactcctgtgccacaaaaaaactttgtttttgccatatctgagcaccacttaagactattaaacaggttcacttttttttttttttttttttttttagacagagtctcgctctgttgccaggctggagtgcagtggcacaatctcggctcactgcaacctctgcctcccggtttcaagtgattctcctgcctcagcctcctaagtagctgggactacaggcgcacaccaccatgtcctgctaatttttttgtatttctaatagagatggggttttaccatgttagccaggatggtctcgatctcatgacctcatgatctgcctgcctcagcctcccaaagtgctgagattacaggagtgagccaccgtgcccagccccactctttttatttaaagaaattaatttcaggctgggtgtggtggctcacgcctgtaatcctagcacttcgggaggccgaggcaggcagatcacctgaggtcgggagttcgagaccagcctgaccaacatggacaaacctcatctctactaaaaatacaaaattagccaggagtggtggcacatgcctgtaatcccagctactcggggggctgaggcagaagaattgcttgaacctgggaggtggaggttgctatgggctgagatagcaccattgaactccagcctgggcaacaagagtgaaactctgtctcaaaaaaaaaaaaaaaaaaaaaaaagaaattaatttcaaaaggaagcatgaagcatgttaactactacaatgggaagtgactatcacctgtcctaaatagaaggcaataaatacatttatttattgtaaaataaatacagtaaacacaaagcagtggccgagcatgatggctcacacctgtaatcccagcacgctgggagcccaaggcaagggaatcacttgagctcaaggcaagggactcacttgagctcaggaggttgagaccagcctgggcaacatggggaaaccctgtctctccaaaaaaaaaaaaaacggctgggcacggtggctcatgcctgtaatcctagcactttgggagctgaggcaggtggatgacctgaggttaagagttcgagaccagcgtggccaacatggtgaaacccccgtctctactaaaaatacaaaaatcagccaggtgtggtggcacacacctgtaatcccagctactcaggaggctgaggcaggagaatcgtttgaacccaggaggtggaagttgcagtgagccgagatcacgccactgcactccagcttgggcaatggagtgagactccatctcaaaaacaaacaaacaaacaaacaaacaaacaaagctggatgtggtgactcacacctgtaatcccagcactttgggaggccgaggtgggtggatcacttgaggtcaggagttcgagaccagcctggccaacatagtctctactaaaaatacaaaaattagtcgggcatggtggcacatacctgtaatcccagctactcgggaggctgaggcacaagaattgcttaaacccaggaggtggaggttgcagtgagctgagatcgcaccactgcattccagcctgggcaacagagtgagactctgtttcaaaaacaaccacaaaccagggctagtaattctaactcacttctgctttccaaaagcagaatctgagggctgctctctcttttataaaaggaagatattcgaacaaaaggccagtgacaaaggctgtgttatctacagagattttcttccaaacagaatcagaaatatagaaaatggatacacttttttgcggtgtactccaatgttatttagagcagcacagcacagtacataaaattgtctcaagtcgtttaggaaatgctgaggctagaccagaaacaagagggagaaaatcgcccgtttaacaactttccccttcatgaagctcgagacacatataggacatggggcaaagacctggtgtggctcagggactttccacctcctagctgtgtaaccttgaactcacctgtcgacatttggaggcctggggattctcaagaaaaatgcagttaatgacagcttgcctgcctcacagggtcccttaagaaccaattgtgagcctacatgtcacaagccctcatagtctgtaaaatgctgaataaatagagcagattgtaaggctattccctgaggctaggcatgaggaggtgagctgtgaggaagggagaaccagctcattaaccaggggaacaaatgacagtgtgatggcatccctcccacatccatgggggcctctaaaatcaaggagccagccagtggtagggcctagagatgagaggactggtggcctctccaactgctttccagttccaggacctccagcttgtcaccaggacaaccaggcagccctcactccctgcacggcagctcaggtgtcaccccaggacatggaattgatcgagaggcctctgccccttcctttggtaggtttctttgctgaatgctcaagaagcagctccctggttaggaattccaagaacttctaactgacagggagtcccagctgtcccatcatggaaggcagccaccatatgtgtggagagactgtgaactgtgaactacacttacgtaaccctgaactcgagtcttgctcacaagacccagctcatgttccctgcgctgcgaagcttcccaggaatggtccgtggttgttctgtctactgttgcatttgacacagggctctgccaaggtattcaccacatctgcttgtatatccatctccccactagactctgggcaagcctccaactttcaaattattattatttttttgagacagtgacttgctctgttgcccaggctggagtgcaacactggtgccaacatggctcactgcagcctcgaactcctggactctagtgatcctcccacctcagcctcttatgtagctgggactgtaggcatgtgctactatgcctggctgattttaacagtttttgtagagacaggggtcttgcaattttgcctaggctggtctcgaacttttgacctcaagtgatccacccaactcagccttccaaagtgctgagattacatgcatgagccaccgtgcccggcctaaacctcccattttatgtttcctctgcccctggtctaactcagtgcctggtatgtggcagacacacaggtcagtgttacaaatgaccataccctcacactcgctgttccaaatgatggcttcttactaagaacctgagaatttctgcctgcgggttttgtctgggtgcggatcaggccaaagttccatggagttaacaccctggggcaacacttaagcaatgaaaaccagcagttagtggatgaatagcccagcacgggacaaccctggggcaggttctgcacagtcacctggccagacccagcagcactgagccctggctgtccacagcagtgactgctcataaccactctgccttctctttcagtctcacttcccctctaccatctcacgctttctgggtcaaagaaactactatcttggggtctgcttctgctggagctcaaaccaagacaactggctagttggctgattggctgtgtgaatgggcacgattagcagcaaagaaagaaatggaagcccgcgcgccggctgggccctggcacatgcgctgcccccacagtgtgtctagactacgtcggggcacgtgcacagccaacagatccgacacaggaaaaagcacttctcagctgtccccaccatcctgctatttgtcattccatccatctgctgtccccacgaaacgctcacccacgtcagctaaaatggtacactgggcttggaatcggctggggaaatgtcaggctgacagaacaggggggacaactgaaatagcaactgtgtggacggtggtggtgacacaaatctgcccctttgcgtagaaggcaggactcccagagctcaggaggcctcttgcggaggaattggtatgtggcgaaggctgcagggagggggccctgggactcaggggcagctagagcagggccctctgccctgagagctcttcaccccttcctcccagaatagaggagattgtccaaacatagaactcagtttgtttaaagtcattgtttatttttaaatgttcagttcgttttccaatcaatcttccacggtgcagttcaagaaaaatgtgtggattttcatgcctgaggtcagttgcaggatgtacctcgcagaacagcgtgtgcccctgcaagctggggattgagtgttttgttctgttttgttttctcagggtaaaggggtcattctaaaagcaggactgtttggatcttagaagattggatatttatttattatttaaatttttttcttttctttttttttttttttttgagatgaagtctcgctctgtcacccaggctggagtgcaatgggatgatctcagctcactgcaacctccgcctccccagttcaagcgattctcccgtctcagcctccccaaccagccgggattacaggcgtgcaccaccatgcctggctaatttttttgtatatttagtatagatggggtttcattttgttggccaggctggtctcgaacgtttgacctcaagtgatccactcacctcggcctcccaaagtgctaggattacaggcatgacccaccgtgccgggcctattttttttttaatttattttagagagaaggtctccctatgttgcccaggccgttctcatactcctgggctcaaatgatctgcccacgttggcctccaaaagtgctaagattacaggtgtgagccaccgcgcctggccatggatacttatacattctttctacaaatatttattgagtgcctgtgttgatctaggcactgtcttgagctccaggaagaaagcagtgagcaaattcaacaaaattccccacctcttcgagattacagacctgtgggagggctggacagtaaacaaatatatgtacaaatgtcaggagattttaagtgtgaagaaaagcacaggggccaggtgtagtggctcacacctgtaatcatagcactttgggaggccaaggcgggtggatcacctgaggtcaggagttcaagaccagcctggccaacatggcaaaaccctgtctctaccaaaaaatataaaaattagctgggcatggtggcggacgcctgtagtcccaactacttgggagagtgaggcaggagaatggtttgaacctgggaggcggaggttgcagtgagccaagattgcaccatcgcactccagcctgggcgacagagccagactctgtcaaaaaaaaaaaaaaaaaaaaaaaagggaagaagaaaagcaaaggaaagaaaatgcaatttgagtatttgagtttgggtggccagggaaggtgttccagtcatctcactgcatgctaagccacctcaagactaagtgacttgaaacaacaatcatttgcttatctctcatgattctgtggactaactgggctcagctcggcagtacttttgttctatgcagattttctctgcagctacagtccactggcgcttggccaggctggaacggccgggatgcctcacttacatgtttggtgtcctggcagggatggctggggggatgggctcagtgggggtgtttggtcaactgggctccccttccaggtagtctcagcacctttccctctccacaaggcctgtctatgtggcctctcacgtggtctctccatttggcctttccagcaaagcagccagacttctttacatgacagcttggggctcctgcaattcagaagcagaagctgccaggctgtgtcaaggcttaggcctggaattggcagggcatcacgcctgccacgtcctgtttagttgaagccaggaccggctgagatcccatgtgggaggaggccacacaagggaaggggtgctgggaggcctggctccttgcgggctggccacccatgcctccctgaccgtgcgctggctaagcagagaccaggacagaggaaggagtgggccctgcagcgctgaggggacacgcaaagtccccgagtcagggctgtgctgcaggagcagcaaggaaagaaacaggccactgtggcgggagctgaacagcagagaggaaagataaacgacgaggtcaggaggcagccagggaccagactgtcccggccacaggccacagagagggattcaggagttattcctagtgggatgagaagcaccggacctgccttgatccataactggtgggttctgaagctggggacatctccgccccatccccactgctgggttcgcatgctgcccagaacggccctgtttcaactgcagcccctgctcccagcaccctccggctgcctctctgcctgatggtctctctgtggcactcagcaccactgcatgcctgatattttactgatgtccctattgtcttgtttaccttctcactctagaatgtaaacctgaaacagacagggatgtctgtctgtttcatccgtaggcccacaaccattaaatagtatttgttgtaccaatgaactaaccagcccatctctgtaaccccagttggtgctaacactatattgggcctctagcaaaaactgcatgactgaattaatgcaacaacaacaacaacaaatacatatatatatatatatattttttttttttttttaagagacggagtctctctttgtcgcccaggctggagtgcagtggcgtgatcttggctcaccgcaagctccacctcctggattcacgccattctgctgcctcagcctcccgagtagctgggactacaggtgcctgctaccacacctggctaatttttgtatttttagtagagacagggtttcaccatgttagccaggatggtctcgatctcctgacctcgtggtctgcccccctcagcctcccaaagtgctgagattacaggtgtgagccaccgtgcccagccaaaaaaataatttttatagttccagtcaacttatctaaaagttgctttcaaataagcaattatccagggaaaatgaagaagaaaaaaaaagccttcaaagtagcccatgccatgaccgacagtcacaggacagcctctcattcacctatgatcctggtgtacttggtaagtcagttaccaagcagtcatagcctggcgagccctggattaaaggaggagaggcctggaacaagaaggaaaatgccagctgtcagtgaggggaggacagaaaactcaaaacacaaatgtggtcgggtcagcagggcgatgtttcagagcaaagcaatctagggctgcatggcagggacaagctggcccgtgggcctcagcagctctccaagctgtgccagcaaaccacctgacaacaggcgatatctgtaacaatccttacaacacttttcttttttttttttttttcaagaaacagggtctcatatgctgcccaggctagactcgaactccagggctcaagtgatcctacagcctcagcctcccaagtagctgggattacaggttagtgacaggtgcctggctaatttttttttttttttttaatttttattttttttattgatcattcttgggtgtttctcgcagagggggatttggcagggtcataggacaatagtggagggaaggtcagcagataaacaagtgaacaaaggtctctggttttcctaggcagaggaccctgcggccttcagcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcgacaggatcccaaggcagaagaatttatcttagtacagaacaaaatgaaaagtctcccatgtctatttctttctacacagacacggcaaccatccgatttctcaatcttttccccacctttcccccctttctattccacaaagccgccattgtcatcccggcccgttctcaatgagctgttgggtacacctcccagacggggtggtggccgggcagaggggctcctcacttcccagtaggggcggccgggcagaggcgcccctcaactcccggacggggcggctggacgggcagggggctgacccccccacctccctcccggacggagcggctggccgggcagcggggcgcctcacttcctagtaggggcggccgggcagaggcgcccctcacctcccggaccgggcggctggccgggcggggggctgacccccccacctccctcccggacggggcggctggccgggcggggggctgagccccccacctccctcccggacggggtggctggcccggcagaggggctcctcacttcccagtaggggtggctgggcagaggcgcccctcacctcccggacggggcggctggccgggcggggggctgacccccccacctccctcccggacggggcggctggccgggcggggggctgaccccccccacctccctcccggacggggggctgacccccccacctccctcctggacagggcggctggccgggcgggaggctgatccccccacctccctcccggtcggggcggctgccgggcggagacgctcctcacttcccagacggggtggctgccgggcagaggggctcctcacttctcagacggggcggctgccgggcggaggggctcctcacttctcagacggggcggctgggcagagacgctcctcacctcccagacggggtcgcggcctggcagaggcgctcctcacatcccagacggggcggcggggcagaggcgctccccacatctcagacgatgggcggccgggcagagacgctcctcacttcccagatgggatggctgccgggaagaggcgctcctcactttccagactgggcagccggtgcctggctaattttaaaactattttgtagagacagggtcttgctatattgcccaggccggtctcaaattcttggcctcaagcaatcctcctgtcttggcctcccaaagtgctgggattactggtgtgaaccaccatgccggtctggagtcattcttggctcctctctttttctcagtactagggtgactgtataattcattatataaacctgaacttccccagacaaataagttgtatggtctatccattaacccactccaatccatcagcaaatccagttagctctattataagagacatatccagcatccggccatttctcacctcctccactatcatcctggtccaagcattcatcgtgtcctgcctttatctttgcaatggcctcctagttgatcccccacttctagacttgccttttacccccaaatctgttttcacagcagccagagtaagcccgttaaaaataagtgagatcatgttactcctctgctgaaaatactcggcagttcagaggaaaatcaaaagtctttaaaatggcctacagcagcagtccgtttcctgcaaccgctctgacctcattcacatgttccccatctcttctcactccacgtaagctacaccagttctcgcgctctccaggtaagtcaagcacactcccacttcagcctggccttcgactttgctcttccccctgcctggaatgcttcccacataaggacagggcttcttctttcattcctttctggtcacaggtccctgactcctgtataaaaaaatgacatcacccactggctgctctgaaaagccatctttgcattgttccttgtccggctccttgctcgccgcagccgcctttaccgctgcggactccggacacttcatcaccacagtccctgaactctcgctttctttttaatcccctgcatcggatcactggtgtgccggaccatgtcagacgcagccgtagacaccagctccgaaatcaccaccaaggacttaaagaagaaggaagctgtggaggaagcggaaaatggaagagacacccctgctaatgggaaggctaatgaggaaaatggggagcaggaagctgacaatgaagtagatgaagaagaggaagaaggtggggaggaagacgaggaggaagaagaaggcgatggtgaggaagaggatggtgatgaagacgaggaagctgagtccgctaggtcaagcgggcagctgaagatgatgagaatgatgatgcctataccaagaagcagaagaccaacaaggatgactagacagcaaaaaaggaaatgttaggagggtgacctattcaccctccacttcctgtctcagaatctacatgtggtcacctttgagtattgaggcccgctaacccacccactgcgggcagtgccacccgcagatgacacggcccacccgcccaccgagggcagtgccacccgcagatgacacggcccacccgcccaccgagggcaatgccacccgcagatgacatgcgctctccaccacccaacccaaaccatgagaatttgcaacaggggaggaaaaaagaaccaaaacttcccaaggccctgcttttttccttaaaaatactttaaaaaggaagtttgtttgcattttttaatttacattttatatttttggacatattgttagggtcagccatttttaatgatctcagatgaccaaaccagccttcagagcgttctctgtcctgcttctaacgtcacttgtgatgtgaccatgttcgttataatctcaaaggagaaaaaaaccttgtaagacaagcaaaaacgacaacagaaaaacaatcttattctgagcattccagtaacttttttgtgtgtgcgtacttagctgtactataagtagttggtttgtatgagatggttaaaagggccaaagataaaaggtttcttttttttccttttctgtctatgaagttgctgtttatttatttatttattttttgcctatttgaggtatgtgtgaaacaatgttgtccaacaataaacaggaattttattttcctgagttgttctaacaacaacaaaaatgacatcagctgggcgcggtagctcatgcctgtaatcacagcactttgtgaggctgtggcaagaggattgcctgaggccaagaattcaagaccagtctggacaacatatcaagaccccatctctccaaaaaatacatacaaattagctgggcatgggagccacttgggaggctgaggcaggaggatcctttgagcccaggagttcaaagctgcagtgagctatgtttgcaccactgcactccagcctgggcaacagaccaagaccctgtctcaaaaaaatcaaaacaaaatgacaccaatctctatcaacatcacctccacctcatcccagctctccttctcttacatggtaaattaaattttctaacaatggctacagttatgtatgttcccacaagttcttctagaaccattcctcccgtcaagagagttttcttttttttttctttttttgagacagggtctcactctgtcacccaggctggagtgcaatggtgcaatctcatttcactgcaacctctatcttccggttcaatcaattctcatgcctcagccttctgagtagctgggactacaggcacgtaccaccacacccagctaagttttgtatttttggtagagatggggtttcaccatgttggccaggctggtctcgaatcctggcctcaagccatccacctgccttggcctcccaaagtgctgggattacaggcatgagccaccacacctggccaggagagttttctttctctcgccttgaatatgaaccagcctttagtaactggcttctaataagcaaactgtgacagaagcaacgctgcaggacttttgaggcccgctcttaatttgtgacacagcctccacctgactcttcctcttaggaccttctcctttggaacctaccacgtccttggagcccaaaccagcccacacagagaggagaccataaggagaggtccatgtggagaggaattgaggcccctagccaaccaccagcatgaactaccaggttcacgagagaatgggccttcagatgaagcccaggccccagcctttgagtctttcagctgaggtcccagccatggtggggcagggaaagctgctcctgttcccctatgctaggccctgtccaaatctttgacccacagaatccataagtttgggcccatctagttgcacggtcatagtaaccagaacacctcatttaatttttctctatagagtctaacataatgtgtatttacttgcttctctattgtctacccacacccccctccaagagaacgtgagttccttgaaggcagaaacttttgtctattttttctagcctcagtatctagaaaagtacctagcacacagtgagcacttgaaaaatatttgttgaacaaatgaattaaagaaaactgctaattaaagaaaactgctccttactataattcgcaacaccttctgctgaggcatgcgaccttttcctgaagaaagtgttctctggtgtgttttggaccagctccctgctaaaaaatatctcttgtcagccatctggaaaatgataaagttggatccatacctcccactatacaccaggaaatagtccaagcggatcaaagatttatacatggtaaaatgaagccattcaagtcctagaaaaaagccccgtagcattctgatgtcgccttggagtaggaaagcctttctagctacgactcagtctccagcagccattaaagaaaaagatgggctgggtgcagtggctcacacctgtcaccccagccctttgggaggccgaggcaggccgattgcttgagctcaggagttcgagaccaacctgggcaacatagcaagacatctctactcaaagaaaaaaaaaaaaagaaaggaagaaagaaagaaaaagatggatcaactcaaagtacataaaaataaaaaacttctgcttggtcacaacaacaacaaaacagaatgagcaaaatcaggccgggcgcggtggctcacgcctgtaatcccagcactttgggaggccgaggcgggcggatcacgaggtcaggagtttgagaccagcctggccaacagggtgaaactccatctctactaaaaatacaaaaattagccaagcgtggtggcgggcacctgtaatcctagctacttgggagactgaggcaggagaattgcttgaacctgggaggcggaggttgcagtgagccgagaccacgccattgcactccagcctgggcgacagaacaagactccatctcaaaaaaaaaaaaaacaaaaacaaaaacagaaaaaccaaagaaacaaaaaacttctggagattaggcagaaaaaaaagaccaagctaggcagaaacccagtgggaaaatggacattcaggcaggcagttcacagaaaaggggactataaagtcagccctctgtatccaagagttctacattgtggattcaaccaacgacaggttgaaaatatttggggtcaggagcagtggctcatgcctgtaatcctagcactttgggaggctgaggtcggagaactgcttgagaccagcctgggtaacatagtgagaccctgtctctacaaaatattaactgggcgtaatggcacatgcttgtagtcccaacttctcaggaggctgaggtaggaggatcacctgagcctgggaggtcaaggctgcagtgagccaagattatgccactacactccagcctggacaacagaatgagatcctgtctcaaaaaaaaaaaaaaaaaaaaaaaaaaaaaaaaaaaaaaaaaaaaaggaaaaacctaataaaaataatataaataaaaaacaacaaagcataactactatttatatagcatttacatagtattagctattataagtaatgtagaaatgatttaaagtatatggaatggctggaagtggtggcttatgcctgtaatcctagcactttgggaggccggggcgagaggatcacttgagttcaggagtttgagacaagcctggaccacatagtgagacctcatctttaaaaatacacatatatgtgtgtgtgtgtgtgtgtgtgtatctatgtatgtctatatatctatatctatatctatatctatctatctataattaggccatatctatcaacattataaaaaccagcaacttacatcataatgtgccaaacttcctgatatattttgaaaagatccccaaaactcctagaagttttatatctatatctatatatatatatatatatatatatctccatatatatatatatatatctccatatatatatatatatatatatctccatatatatatatatatatatatatatatggacgtatatatatacacacacacacacatatatatatatggaaggatgtgcgtagtttatatgcaaatactatacctttttttttttttttgagatggggtctcactctgtcacccaggttggagtacagtggagcaatcttggctcactgcaacctctgcctcccaggctcaagcgatcctcccacctcagcctcccgagtagctgggactacaggcctgtgccaccagcctggaaaattttttgtatttttggtagaggtagggttttcccatgttgcccaggctggtcttgaactcctgagctcaagtgatctgcccgccttggcctcccaaagtgcggggattacaggtgtgagccacggtgcccagccagtactacaccattttacatcagggacttgaacatctgtggattttggtatctgtagcggtcctggaaccaatcccacgcacatagactgtacaaatggcccttaatcatatgaaaaaacattaactctctctcaaatataacaaaaatataaaattataccgaaaacctatttcttccatatcagattggcagacatcccaaaccatagcaagacaacactggcagggtggtgaggtcacaggcactctcacacatcacaaacaatacaacctctgggtagggtaattaggctgtatctatcaacattataaaaaccagtagcttacatcataatgggccaaacttcctgatatattttgaaaaaaacccaaaactcctagaagttaggcagagaaaaagaccaacaccccagtggaaaaaggggcgttaaagcagttcacagaagaaggaactacaaatgacccttaattgtatgaaattgttagctctaaccattgcatttctgggaatttatcccacagatatatttgcacctatatgaaatgacatatgtatattactcattgtagcattctccatagtagcaaaatattggaaataacgttactgcctatcaatagaagactgatagcctaaattatggcacatccatataatacaataccagatagctgtaaagaagaatgaaaacacttttttttttttttttgcgatggagtccactctgttgcccaggctggagtgcagtgtcacagtcttggctcactccaacccctgcctcccagtttcaagcgattctcttgcctcagcctcccaagtagctgggattacaggtacacaccaccatgcccggctaatttttttgtatgagaacacttttttgtactattttggaaagaaccactagatgtactattaaaagaaaaatgcatatacacctactatgtacccacaacacttaaaatttaaaattaaaaaaaagaaaaatgcaaagttccaaacagtatgtataatatgctatctgctaattaaaatgctaaaagaagaagaaacagtggacagcaagaatacacacattcatgtttgcttatatatgggtaaagaaactcaggaaagttacaggaggagctaataacagtggttaattacaatggtagaggagaggcttggcagataagggactcgtttgcagatatgactttcctttgtgtacatttctatatattattttacttcttctgaaaatgccacataatttgcaataaatgattcactccttagctccaaaagcaagtcctttatcaaaatgcaaatgttccagagggatgtagccagattctgtggaccgccgtctttttcacccttaagaatccgtcgctatgatttctcttcctctgcttggagacctttagagagccagcctgcagctgctcagagcattgactactaaacagctcacagttgctattgctgaaaatgcccggtggttatgccttgcctgaccaggggtagcccacagctgatgacaggcccccttgcctcaaggtgggacaacttcggtggtgccattcatatccagagctgcctggaatcaggccgaggctggacatcagccgaccccgcatctttgctgagtttattcctctgctgtacttccctcgcttccctcacctccttcttggtttctcctgagagcctccctcaataaatcacttaccccagaatccttgtctcagactccgcttctaggacccaacttaagacattcacaaaataaatcacattgatggaaaacagatcccattctccaaaatgaataaccagtaggcacttgtgactagcacaagcatcagcatatccacatggtgctaaactaacaccaacccaaagcagatagtgctgggtggactcggtacaagttaatagctcatgggtctccatccccaacaccttcagacccaaggctccagggctgccagcctgagaaccctaagtcatgattttgggcactttggctggatttcctagcaactggctgagagcaggacaggtaaacagagttgggaggaggaagcaaaaaaggctagagtggacatcagttgactttgcctgccatggtagagactttcagtcatccaccataatccatccccattctgctgcacagaagtattgtggctgagacacctgcttttctccacccctctagttaatgtgactaaattctccctatggaatgggaatggaagggccatacccaggccagtgtcttcaggtaggggctgtgacccttccacacctgtaccagacacaatcatcatctcactgggttttgccagctttcaggtctatgtgctgaaagctgcttacagctaacctctgcagattttcctggcacaggaggcatgcttggccagtgcacagggcaagttggaagggccctaatgtcagcagccttcaaccaatgatggatggaaagttgcagacagtgtcctatgcatctgcagtgggataactctgagacgtgtgctgtactgcctcctagagggcccagggtgattaagcaccagttacccacagcagtaacttccttgattctgttccccacatgggcacttttcttcctgtcacacctccccaatcccctgcagatactttctgggattgcttcctaaacaatccacttgaactttttttttttttcttttttttgacatggagtattgctcttgttgcccaggttggagtgcaatggcacgatcttggctcactgcaacttccgcttcctgggttcaagcaattctcctgcctcagcctcctgagtagctgggattacaggcgcctgccatcacgcctggctaatttttgtattttcagtagagacggggtttcgccatgttggccacgctggtctcaaactcctgacctcgtgatctgcccgcctcggcctcccaaagtgctgggattaccggcgtgagccaccgtgcccagccccacttgaactttaatccttgcctcggaattggcttctggggaaaccaaaaatatattaaaaaaagagagaccaggaccttaaaaagagcccaagttgttgagctccctgccaagtcacccccaggtatctctgcccaccagcttgcatgagccagatcctcagtgcaggtttttccaatcagtcatttgttcttccacccaacgctcaagatttgcttcttcaagacaactctctgatcagctgagacccatagacacccagcttctaccacacatatgatggcattatcctagggcatggcagagcaacgcaagggaaaactctgggcccccaagtgatgtcatggaggagaactctcaacccagaactactacgtgagaaacaacgctctctcttctttaagccataggtgtgttgggaatctttgttacagcagcacgcctgatcttttgttttgttttgttttgttttagagatggagtcttgctctttcgccaggctggagtgcagtggtgcgatcttggctcaccatgttggtcaggctggtttcaaatccctgacctcaagtgatcctcccaccttggcctcccaaagtgctgggattacaggtgtgagccaccgcacccggcccagccatgccttgtcttaactagcatagccgcccaacgtccacttcttttggccatgttgtcctgattctgctggagaatccctttcccactgctcccagaccagtggtgtagctgacctgcgctctctccactcaattcaggggagggaggggtttaggcctgggctaagagagctgcacatttcccagggcacagtgattagttgagggtgggtcccagagccaaatctgcccaagatcttagcctgaaagagaaaccctcctgctgagtgactgcactgtgaggcagaagtccagagctgtgggtggccatccagcctccatttgcgcctgcctgagaaagaagccaccatgggggaaatcgagctaaaagacggagagggaggtaagagaggatgacatcacataagcaccagatctggccacccctgaaactggaacaaccctaagctttacagctactacattcccttttctgctgaagttgttttacactgggtttctgtctcttgcaaccaagagctctgttaaataaaaacctgaccctaaggagaacgttagctggttcacaattccctgtgcaaaacaggcacaggtcagctgccccagcctgtcgtttggatattcctttctaagaacgctcacttttgttgtctacatgacccagataaccaaggagaaagcaaatcaaccgccttccagcggcgccttccttggcagcaagtgctaagagagaacacaatgtgagtactctgccctctggagtcagggttgatcctcagcacttgctgtcctgggaggctgcacctgtgacacttgagtgccaggttcaacccctactgctgctgctgctgcctgaatggggccatttagactgttgagtgctacagcctcagcccaggaacccggagcttcacatgaggcagagcagggccccagggtccctgaaacttgccagttcaaacagcagaggggtgaggactccccagtcagccctggtctcatacctgcctctgcatggtcccagtccagcctgaggcctttgctttcttttttgaagggaaggtgaggagagagggggaaaatagaggtgttctgactagacttaggattcctggcctctgcctctgaccgccagaggacagcctctgcagttgcctcatctactcatgaaaacaggcctgtgaccccaggggtgctctgaggattcttccagaaaacatctgcccagctaggactacctagctcactgcccaaaaagggttcatttcctttccttctgaaacaaaagcgcttaattggaagagaagcattgactcaagctataggatatgccacttaaaatgtccagatcttggcacaaggcctggcgcacagtgtgggagagaaggagagaagaaggtggaaggaaaggagggaggggaaagaggaagcagggagggagaaaataagacaagggcctcctcatctggatgcttccctagaccaagaagtggcccaggtggtgcccaggggacagggagtgggcaataaaagacaatggggtgtaggtgatagggtgtagatgatcagggtataggtgatcaggatgtaggtgatggggtgtagatgactggggtatagatgattgaagtgtaggtgatggggtatagatgatcgaggtgtaggtgatggggtatagatgattgaggtgtaggtgatggggtgtaggtgatgggggtcaaggtgatcaaggtgtaggtgatggggtgttggtgattggggtgtaggtgatcagggtgtaagtgatggggtataggtggtggggtgtagatgatcggggtgtaggtgatgggtataggtgatggggtatagatgatcaggttgtaggtgatcggggtataggtgatcaggttgtaggtgatggggtgtagatgattgggatatagatgatcgagatgtaggtgatggggtatagatgatcaaggtgtaggtgatggggtatagatgattgaggtgtaggtgatggggtatagatgatcgaggtgtaggtgatggggtatagatgattgaggtgtaggtgatggggtgtaggtgatgggggtcaaggtgatcaaggtgttggtgatggggtgttggtgatcggggtgtaagtgatgaggtataggtggtggggtgtagatgattggggtgtaggtgatggggtgtaggtgacgggtataggtgatggggtatagatgatcagggtgtaggtgattggggtataggtgagcagggtgtaagtgaaggggtataggtggtggggtatagatgatcaggtgtaggtgactggggtttgggtgatggggtgtaggtgatggggtatagatgattgaggtatcggtgatgggggtcaaggtgatcaaggtgtaggtgatggggtgttggtgattggggtgtaggtgatcagggtgtaagtgatgaggtataggtgatgcagtgtaggtgatcagggtataggtgatgaggtgtaggtgatggagtgtagatgattgaggtgtaggtgatggggtataggtgattggggtgtaggcaatggggtgtaggtgatcggggtcaaggtgatagaggtgtaggtgatggggtgttggtgattggggtgtaggtgatcagggtgtaggtgatggggtataggtgattggggtgtaggcaatggggtgtaggtgattggggtcaaggagatagaggtgtaggtgatggggtgttggtgattggggtgtaggtgatcagggtgtaggtgattggggtgtaggtgatcggggtgtaggtgaccagggtataggtgatcagggtgtaggtgatgggatgtaggtgatcagggtcaaggtgattgaggtgtaggtgatgggatgttggcaaccagggtgtaggtgatcaggatgtaggtgatggggtgtagacgatcagggtgtaggtgatgggctgttgctgaccagggtgtaggtgatcagggtgtaggtgatccgaacttcctactcaattcaggcaacagctcccagcctgaggcaaataccccccgaggcagtcagggtctcacctcccatggctctgacgcaggcctccaaggtgaggagatggaggtagcagaggtcacttcactcagctgtcacacaccctgagggaactcctgtcactgttatcccacctgcaagtgaggagccagcatttctcatgctccagggttggccacagagcccattcaagggagggagaagagccttcggccagcgcatcctaaccgcagaaagccaagacctctgcagaaaaagagaccaggcccataaaaagagatccatgagttgagttccctgccatgccacccccaggcatctctgcccaccagcctgcatgagccagcccctcagtgcaggtttttccaattggccgtttgttcttccacccaacactcaagatttgcttctcagcctggacaacatagcaaaaccccatctctacaaaaaatacaaaaattagctgggcatagtggcacacacctatagtcccagctactcgggaggctgaagtgggaagattacctgagcctgggaggtcaaggttgcagtgagccatgatcatgccactgtactccagcctgggtgacagagtgagaacttgtctcaaaaacaaaaaaagagaggaagatctgcttcttcaaacccacacaactaatataaagtaatcaacctccccacctcaataacctgaagttaaacatcacacaataagccctgaacagagagctgtaggtcaatgttccattttgcttttaaaagcttcacaagaacatttcatttattaaaatagtttctgtaaactctttcagaataacaaaattcacttgccttgcttaaacagcatttcaagtagaagtatttttatttcaaggcaccataaaatgatgatctctctaagaaatacctctccttccgtgtgtgaaaatccttgggggaaaaaaaaatcccacacggtgttcttggccatcaggatcatgaaaacaaactttggtgaatgtgagcaactgcgccagacaggacacaggttacagggcctgacgtcactaacggcaactgacaatcttggaatggaccctactgctgatgtttcaaaaggacacagaggtgaactggtcacttctaattaagaagagccagtggggtgggggaagctgaaaaccaaaaatccacgtagacatacgtggcagtgtgaacgtctgtcctccccttccttctcctcacttcctctcctcctcctcactcaggctggtattctcctggtgtgcggatgtcagcttgccctgcagaagggctgccagttttttagatgtctttttgagaaacgagctgcccggatgggcactgttcacgtgcaggtacaggtcctcctgggtggggcccgtgtagccgcaatcctcgcagacgtagagcttgtcccgccgctgcttataggcatactgctgctgcaccccatggattttcttcaggtgggactccagagagcagcgctgggtgaaggctttattgcagacgttgcatttgtagggacgaatgcctgaaaggatgagggacagacacagcatcggttggtcatggccaagccagaaccacccaactatgaagccagtaaaagtcatgccatgaccaaggattcatggcagcatgaggacaatggttacagcaggagagaaaactgtctacaaaaaatcatagcatccacctgagtaaacctaacacaaacagatgccaacatagaaaacaaacaaacaaacaaacaaacaaaaccaccacctgctttagggaggaagatttttattcttccaactcacataccttaatgttttcatattattgtgagcaaagtaaacttttaaaaaaaattaattcgggccaggtgcagtggctcacgcctgtaatcccagcactttgggaggccgaggcaggcggatgacttgaggtcaggagttcgagaccagcctggccaacatggtgaaaccccgtctctactgaaaatacaaaaaactagccaggcatggtggcgcgcacccatagtcccagcaactcgggaggctgaggaaggagaatcactggaacccaggaggtggaggttgtagcgagctgagatcgagccactgcactccagtctgggcaacagagtgagactccattaaaaaaaaattaatttgggtattcccagaaacagagcctgggacaaagattccagtacaagtagtttatttgagaggtgatcctgggaagaacctatagggcaacgaagatgtgaggcagggaggggtaggatccagtagaggggaagctacccagccagttacacggtggacaaccagggtccagtcctctgtgcaacgcagggagacagtgtggcacacaccttggcgtcatcccacccctccaggagctgaggtcagtcactggctgccggctgctcctgggtggttttgattctccatccccagcacttctgcctgccttgtgcagacagactgggctccagcagggaacccctcaggcagaggtgcaggggtggacagttgccacttggacaggtgtgcccagaaatggcagatgcccaggccattggcaggaca

SEQ ID NO: 145 - DNA, 4755 bp, Homo sapiens
  source 1..4755: mol_type = genomic DNA
cagtgacttatgccactatggcctctcaactgacttttagtgtgaggccaggagacagagcagccctgggctgagaaactgtttcagctccacttcctccaggaagccctctatgctcagcctcatctaggctccgccagctccgaggtacacagtggaagggactgagcagtccccacagtgtctcctgctgacggggcctgacagctctgctgctgagaggtttcacagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaagtcacctggtacccaggactacttcaaggacagccattgttatggccaacatggtgaaaccctgtctctactaaaaacacaaaaattagccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagtaggaccattaccaaccatgatgatgatgctgaccaatggcagctattgctgcagcacctgctctgagccaggcctgcacttggtgtttgagaggtgggtatgggtataattctcattttagagaggggaaactgaggcaccgtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctcaggggcctgagaacattaagggctgagggcaagcctacccccaacaccttgggtaaatacagattccaacctcactctgcgcccacagcctgctcctctccacctccccagccagaccatggtcctactaccttgccccgccccagggggtaccacagggaccccttcaagacacctgagcaggtggacaagtctctcctggatcacagggcccccagccacccaggtcaagcccaccctgaggttgaatgcaggattgggaagctgcctggcctcccctgcctccctgtgtgaacacagaccacttcctctctctgatcctcccttcctcctccgaagcaaaaggcttcgatgaaactcagtctcctttgttcccctccaccaccaactgccatgtgagtcaaaatgggtaaggcaggctcttcctaggcacatttttgttttaacaggtggctctggtaactgaaagccactgcaagcccaaagaagtgcagctggtgggttttgtgtcaggaagacaaaaaggaggagggaggagggagattctgcagctggagaggcctcccagagtctactgcaacccccactccagtccccaggaaggaaacgcacccctgagggcctgctgttaccagccaggcactgtacaaaaaccaatcagcatgtcagtttccccaagaaccccaagatcttggttttgtcaccccattttacagagggggaagctgagtttcaggagttgtctacctgaggtaccctagctgctaagcggcaggcaggaattcaaccccagtacatctgaagcccagggctaatgcactggcccaccctgccaccctgattctaactcttccccccacactgccccctcttttttgcataaagtggaattggcaaatgagcaaagcaatgaacagcttctacttgagtgcaggcagatctgggttcaagtctagctctgctgcttgccagctgtgtgactttggcaagttccctcccctctctgagtctcagtttcctcataataagtgaagttaataataggacaggaccttcctcagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggaggctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatgccttgtcaagtcgtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgtggtggtggacgcctgtaatcccagctactccggaggctgaggcagaagaatggcttgaactcgggaggtggaggttgtagtgagccaggatcacaccactgcactccagcctgggcaacagagtgagactgcggcacacgcctgtagtcccagctacttgggaggctgaggcaggaggatcgcatgaacccaggaggcagaggttgcagggacccaaaatcttgccactgcactccagcttgggcgacagagtgagattctggcaaaaaagaaaaagtcactgaaggcacctggtacccaggactacttcaaggacagctattgttatgattattgtaacaggcatgtgatcagcactggcctccaggatgcagaatgcctgagtgcctggtgccacctgtgaacataggctgataagggccacccctgcaacccccctttccacttcttccagtgcccagcaggtgctaagtcaaaccaggtgggggtatgggaggcacacccgacagggcaaacttgacttgggcatcccctgacgatgaccctgcatggcaggcacacttgaatgggtgttcagagttctgagcgaaggaatccaagagtggccaacctggagatccagtcgttatctatgaggaacatctgagccccaccccattcccacgggacactgaccatacaggggtatagggaccgaggccctttgttttgggttaaatgaaggttactaggtggagatggttgggagaaggtgttaaatgaaaatgctacataaactgcatgatttgcaagtggttgcggttcttctgctcagtctgccgccactggactctcttccctgtgtctaagcccccagtaaaaccccgtatcttgtttgctacctcttccaaagaaggtagcctcttgaacctggtgctatatccattggagtcaataggggtcccgcacaacagaaggcagctgcctagggccttgctaagcaaagtgtgttcctggatcgttgacattagcatttcctgggagctggtcagcagtgcagcatcgcaggccccaacccgacccacacagaatcacagtgtgaacattaaaagtcaggccacttgagtgcagtttgaaaagcgctgccctgctctgctttcttctagctgaccaggtcccaggcctcagctggtggcaggtatgagaagctgaaggacacagcaaaggctcctgtctcaggaggtttgcacctggggcactggcacctctatccccaaaggcttctgcagaggtagtttaggaaagatggttagaggcatgggatttcgaagccagcctcccttggactcaaaccccagattggacatttcctagctgtgtgatcttgggcctagttaacctctctgtgcctggattaaataaaaaatgcagataatgtgtttagaacggtgcctggcacagaaacatcaacactccattagctgcagctagtaatgctaataattataactgtcatctgtccctcccacaagagggcagggagctggctctggtcacagtggctctgagattcacactccttcccacttctcctgccagctcacacaagttcctcctcaca

SEQ ID NO: 146 - DNA, 78341 bp, Homo sapiens
  source 1..78341: mol_type = genomic DNA
cttcttctaaccaagattgtgaagtgacagaaacatacttcatacttttttcctcttggtagtggaccagaattaagactgggcttttcctgtaatgggcaccatttcagtgccacagtaacagccaggatgtggatttctaccttccttcttagagagggtgaggacacttctgcaataatgggacatgtctgcatgagatgcgtattatttttgctaggttgcaccattgaaacaggttctgaaaacaaggaagatcagtgccaagatccgtttaaatttctatatattcatctgatttaatccttaaaactgtatctgtcctgctggaaaattagctaatcaacttaagagactcctcccatcccctcttctcttctcaaccaactctaactctgtggttaagtatgaagcacagaaggttaaaaatcctggattctttccctaggtctgctactgcatgacctaggtcaaatcatttaaccatcccgtgcctcagcttcatcatctgtacattatagacttcttccagatcgaaaactctgatattctagctcactgcattctgtgtggacatttctataaattccatgaatattctaacagaataagaaaaacttcatgagaatagggaccataatcatcttaaacaccattgcacatgcaaaacttagcatttaatatgtgacctttaaatatttgttgaaattcagaaatgtaaaaatattccacaaatgtaaacacacaaaaacaaaaactaaatgtctcagaaagaagccctacatttggatcagtaaatgggggaatagccagacatatttaatgtataatttagacatttttggagaaagacctgctaatgagccccttctttcagagatttaacttttcaaagcttgcaaaaacattttctcctcctgcagttttaaatgtaattcattataagctgaaagttgtcaataaatgtatctaatgcacataagaaaagtgctattacagcatcattgtccttactcctatagcccagcctcacctaatataatggaaaactaaaatgctatctagacttatgcattatcttgtcaggaagcacctttgtctcactggtacctgtacttcgtagcacgtcacccaatttgatatgccaacattaaacttgggcacacatacatattcacatttaatagtatctttatcttgggaattcaaaataaccaattatggaatgctatggaatcttgaaagttgttctgcaaaatttctagatcaaatctaaacaactacaacctactttttggcaattttttttttttttttttttttttttttttttttttaaaaacggagtcttgctctgtcgcccaggctggagtgcagtggcatgatctcggctcactgcaagctccgcctccagggttcacgccattctcctgcctcagcctcccgagtagctgggactacaggcgcccgccactgcgcccagctaatttttttttgtatttttagtagagacggggtttcaccgtggtctcgatctcctgacctcgtgatccacccgcctcggcctcccaaagtgctgggattacaggtgtgagccaccatgcccggccagcaaatttttaattttctatttcattttattttttagtttggaaaggagagctttatttcctataaagggttgcagcctgcagggtggccatccttggcagatattttgaaactgaaattattaacttgagtttattaataacttggtgataatggccaggggctccattaagttgtacctaaggggaaaagatagtgaagaggcaaaattaagaggctgctatagtcatgctctcatgaaacttgcaatctactctttgagccagaaataatacagagagaggtagaacaggataaacgtggttatgcagtgctcatttcattgaagcacagggaaaataaataatttaaatgagctgggtaggtttaaaaaaaaaaggtataaagaagtggttcttgagtttttccttggataggagaagccaaataagaaagacataaggttgacagtgggagtggtattggggtaggtgaaaggcagaacctcaattccaccataaatggtgataaaatgtaagtccatcagttacatagtaaagaaaaattatggcaaagttttataccagcccttaaggaagctaagctgcagaaaagatacagagaagacaaatcatatttcacctaatatgtcctaaaacactttacagcttttaggggcacagttgaagaccattgatctaatccaatgttttcattttaatcatgagaaaactgagtcccaaagatgttaactgattcctctaaggtcacgtggtagctttaatggccaagacaggactggaatctagatcattctattacatcactgcatttcctgagtttcattttagcatgaatattctcccttgccacatacttatcataaaataacaagatcccattattctcatcctgaccttactgtgtccatgtctgcctgagttgctaataaataacaaaagttgtttccagatttgaataggccctagtagagaatagtgcttagagatgtatcagcaaactcacagggggtaggggtagggattggacaagaagaagtcagtgtttacacaattgagcatagcttttactgttgactggacagctgttccgtctagagcttcttaacccagaaaattactcaattatcaaaagggcacattgattcaccagctgtacattgctaagactttctaatatttaaaagtcataaaggttaccacacttcaaaagatgttattgaatgttactattgcttcacagaaattgatctgtcactatttattcaactattcattcagttgaactcagtgaagagaacctcactgcactgtaaatatttaaatggctcttgttggagacaaagtgaataagcctaagtaggctgggagcagcactggctcaatctgagaacaaatattccgaataaagagcccaactttgcatccaggatgccagcctcaagcagctctattatcaagaacaccttccaagttcacgttgtctgtgcttgagacatacggatgtcccattttaaacttaacaaataaaagtactaagaaagtggtgagaggagtgtagaggaaaataataaactcctaattcttcctaaatctgaagcattaggaaataaagtaacaaaccagttttcctttctgacctcaagcaaatgattgactttagagcccacaatgacctgcttagagctatttagagtgtcaagggccacctagtttcatgtcgttgaacaggtaacaaagcgcaggaaaggagaggcttgggtactgggggataaagtttgtatcaaattgcatcctgaaatctcagccttttccaaacaaatgtaaatacttagctgcatctgaatcattcattttgaaaacccaacagaccttttcctgcgcaagcaggagagattaaagcaacaataccagatgctttgctcaactgatttcctagattgagctgacaaaactattcttgtagaaatctagtcttgcctcctttcacttacagaactgaaatgcctctgtaggttatggagcaaaagaaacccagtggaagggctagagaaatcctactagaggtgacatacctagagctgaaaggtctgagttaggaccacatattgattggctttattgatggtatgataattttcaggtttagtttagctcttcatctgcccatgaccaactttacctgtgactgtggctcttcaccacactgccaccaacccacttggccttcatgtggttacacaaatggaatggaaggtcctaggttttctttaactgtattcacttactcatttattaaatcactgaatctcttactcttgcatccccatttattcagccaacaagccttaatgagtagaaaaggcaggcatgatgctataatggagatgagaaagataaaacgctttgcacagctaggtggtacttgccttgccagagatggagaaggagactgggggcagactggactatctgtaactttggttaggagagctggaagcctccactggatcactggccttgagaagtggtagaggaacaagacaggaattaatcaggaggaaggggcattccacatagagggaatggtagctatgaaggcaaataagcactgaaggtcttgctatgcttggggaagggtggaaagttccatatgcctggagagtaggcagagatgaaaggaaaggcacaaggagtggccagggggttgaaagaattaagactggtgaaataagtcaccgtctaagggtgatatgttttcacctccatcactcctctgaaactgcttttgccaaaattaccaataaaccttattacaacggaatacatgggtaattttcaggcctcattttacttatcatctaggctagtattgtaccaaagggtgggagatgagagttcatgtcaggtgcaggcaacagggagtacattgtccccaaacgatttaaagacagtaataaaaactgacaaaaattgatcggctttctattatcacaatgcaccagcaattccaaacaatgttagtataaaaaactcctctcgaaaccctttggttgatcttagttctaatcaattgctatgcttactgttacattttagtaatataattatatgcatatattatgtcatgttgtatgggtatgtatgccaacttcaaataagaacacttgtattacttatcctttaataaacatcatatatacctgaaagctattctcaggagtttgcagttacatagtctactccagacacacatggacttagcacgcgtgttcatttcaaaagtaaattcataatgattcagagtcagtcaagcttgctttgagcagttaacgtttccatctctgtactacacaccctgttgtaaacatgctatgtttaatcaggagattcaaaataaacaatgacagcacagagactgtaaagacaaagaaacaaaaattgagttattttaattctgtcattgtgttaccactaggagtttttatttgtatttaaaattgaaaacagtgaaagagtgcaaactgtgagatgttcattattgagttggttgttaagcacagattttaattcatacgtgaaataatgtactgaatctgaataatatccttaaaattgaaattcattctttttaaattgtactcattttaaaattaaataacaaatcaagaaaacaaagatggttgcatgatgataattgaaaacagtttcaccataaggtggagagagttgctctgggtgtcaaccacaccaggtgcaccacagattaaggctgcatacaagccttgtgctcactccatccttctctgaacactcttttcctttggttttcatgaaacatgctctcccaactttttcctagctagtggtctctccagcagtgttcacacctcctcatccctgaaaacatcatatttctcagtgttctgtgctagctaggtcgtcatctgttcttaacctacaaggcttctgaacgatctggcttcaataaccaactgtatgctgacgactctcaaatctattccttagctcaaatctctctcccgaaataagctgtttacctaactctctactgagcatcttcttttgaacataacttagacatctccaatccaattgtctgaaactgagttcattaacttcacctcctccttgatcggtctggtaaactaggaaccatccttgattcacccttttccttcctcaccccttggcctctcaatcacccaggctgacaaatatctctcctaaatatcccttatctgcttctttgttgtcacaaccattacgctggctacaccaccactctcctgcatagctccaatagtcattttctacattgtagacagagctctttctgaagagtaaattggatcacatcaccaacctgcttagcactgtttaataacttccatagtctttatttacaagacagaggtaaagaggtctccttttacctttacagccttatctctgagccactgtaatcttacttcagttcttttaatatgtttcaggtggccaggcgcagtggctcacgcttgtaatcccagcactttggaagatggagacgggcagattacctgaggtcaggagttcaagaccagcctggtcaacatggcaaaaccccgtctctactaaaaatgcaaaaattagccagatgtggtggtgctcacctgtagtccaagctactcaggaggctgacacagaagaattgcttgaacccgggaggcggaagtttcagtgagccgagatcgcgccactgcatgcactccagcctgggcaacagagcaagactccgtctcaaaaataaataaataaataaataaataaataaataaaatgtttcaggttctctcttgtctccaaaccattgctaatgctatttccatgtctgatgttccaaggaaaatattatttcctctagaaagcccgactgcctctcagatttgttaggtgctttcctactgcaccctgtcagagcacaaaatggtaatcgcagtttgtctgtcccccttattagtctttaagcgaattagactttaaattctaaaagcagctatcagatctgtcttggtcctcattgtattcctaggaccttgctgtagagtgggtgctaataaatatttttgttaagtgaatgaatgtatgtatgaattgctttggctctaactggaatttgtctataccatggatcgtggatgctttgtctatggcttataatatcaattgttccattttgacttatttcattcctagaaaatttgtcctatgctttgttatttataatcacattaatgatttatttcagaatatactgtaatataaaaaatgatgcatgctaaataaaatctggcaggtttttttttttccccaccattaggaaggaaatggaggtgtaaatacatttaaaattcaccatggggtgatggaatgcacgacttttgggcaaccttaaaactgtcctttcaattttaaatccacacaccaacagaggggataattttaagtctctctttgttgagagcttcaggggagagtgtgtagagtggattttttctgattcaaaatgaagagatacatgaaaactaccaaagtcaaggcacttcatagagaaaagtatgatgctttcattgctgaagagacccaactaaagtctaatgcagaggatgagaaagaaagagggcttgtcatattcttcagccagcacaaccttcccttcatgtttacatcaacagcagtggtgcctcccggtctgatgtttacataaagctgagagtcaactggataccctggctccatgctggcccaaggcagagctgaccacagcaggtaacaggcacctggacggggctccccatgggccatcaggggttctcatcagcttctcttagccggcagattttgaacagtgggtatgttccaaatgtgtcagggcatatttttcaaacatcactgcagattcattcgttatgtcttgcctttttttagaccttgacaataaagggacagttttaaccaaggaagggaaagagaagctcgtgcacactgatattttatgacatgctaggatccacagtgagattaacctatttctttgagatctttggggtcctattttctctgactcctcattattttcctttccaagacagcaattacatcttcaaaggaggaagattcacaccacactttcatgtttatgtgctctgaattcctatgtatttcaaagtgtataccttaaggtaaactttgaaaaaacacaggccactgtattctgctccagttgtgtgtgtgtgtgtgtgtgtgtgtgtgtgtgtgtgtgtgtctcaacttagaatatgcacacctcaagcacaagaatcttctctttgctttattattctccacaggaaatacttgatactaaaattttcacatgcacataaaaaagacaaagatctgtaacatattttgtgcatgtttagtgaagcctgcacttaccctaggaagacatttagaggaacagaatttagagaattaaaatggactttttcgtatttcattatttcccatgtagtagcaagtaatgtattacattcttagggcttctgtaaaaaatcaccataaacttggtggcttaaaacaatagaaatttattctctcactgttctggagaccagaagtccaaaatcagttacacggggccaaaatcaagatgtctgcagggacacattccttccagatgctctcagagagaacctgttcccagcttctcccagcttctggtggctgccaacgtgtcttggcttgtggccccatcactccaatgtctgcctctgtggtcacattgcttttttctctgctgtctgtgtcaagtctccctgctgcctctctctcataaagacttgtaattgcatttggtacctgtctgaataatccatggtaatcttcccatctgaaactcttaaccttaatcatatctacaaacaatattttaccatctaaggtaacagtcacaggttccaggtattaagagatggacatccatttaaggactatattcagcctaccacaggtggtgaaggcattgtcttaataaaaacaaatttcctctggggtgcaagcaagccaagggaaacagaagataagaagtacaagctgtgatagaaagaactgccctcaataaaaatttcatgctgaccctgtaattcagaaatcaatgcaaaaataagctcctgactctggaagaggattgtgtttcaaaattttgtgagtcggttgtttaaagttgggatcttacatcacttttctatagaaataataatacttaagacaattttgattctagtgagccactaaagctaattagacataactgaggtatagaaatagtttacttttgtcttctaagaatctattctatggaaataatcagaatgcaaaaactcaaaatgtgttgtgaagatgtttttagccacattatgtaccatagcataaaaaaagatagaagggagaacttaaatatgcaacaacatggaaaggtttatgcaaattatagaatatccacatgatggaatgttatgcaaccatattaagttgaggtaaaattgttaaagacatgagaaaatgtgcatacaacactgaagtgaaatattgacaatattttttgctcgtgaatctgtgatttggacagagctcagtagggacagcttttctcttctccacttggcatcaactacagcagctcagaggctggaatcatctgaaggctcactcactcatatgtccagcaatggataccgctgtcagaacacctacacctaggctttcaatgtgaccttgccttcctcacaacacagtggctgggttccaagaatcgtgtcccaagaatgaaagccagacagaaccgtatcacctttcatgacctgaccattaaagccaggtaatgccacttttgtcaccttgcattcaccaaggcagtcccaaggcctggccagttctagatggaggtaaaatatgaccccaccccttatacagaggcaaggttctgacactagaaatattgtctggtcatttttggaaaatagagcctctcacacaacgacacaagctatatacaaagcataattctgataatgttaaacacaaaatcgtaattactaaacacataactaaacacataaacacattagaaggaagtagtaatattttatataaatataaataactaattttctttctatcttggtggtagaactatgggtcatttttattctccatgtgctttttggaattcattataaattttagcatcaaatatatttgctgtgagtgaaaatacaaactgacttattagaacagagagcatgtgaacagcacttaatacatcacccttatatgtaatatattatgtaatcctggcaataatctggtgggcaaaggagacaaaactcattttcaggccaagaatctgagactcagacaagcttactgctagtttgtggtggatctggacctcgaataccaggcttttgactccaaagtcttgtttcctagtgtattctcgttccatggtttctcctttaaatggattggaaattgcagctaatgtgtgtcatcctccaggcgagaatctctctgccatcttcatgctcttcattgccatagtcataaatgatccctcttccctctccatagcatcttttttgtcctagaggtaggtcttgggaaagggagaatgaaaaccttggagaagcttctgaaaaggttcaggaaaaagagaatggggaaaggcagaagtttgagatgagggcttgggagaattctcttgcagtgagaaacataagcaggagtataggggcaattttggcttctgttgaaagagggctgaaatagcacagggagggattgaagcatgccttgatccttgactacactgatgctgagataagatagatgagaaaaaagagagcagggacaactttcagaaggatggtcgtttctataaggaagaggagaagtttcataggatagagcagtaaaggagtgattttccagttctaggagctgttcataaagaaatgaaggattttcataatgtgagtgctggtaaatcagaaattgccactaaatctggggggaaaaaaggctatttagcttaagaattcaatggaaattaaatgaattgaaacaaccccaaatttttttttgagttgaactttgctttagaatatatttaggtttaagtggaatatctcatttttttaaaaggaagaacttagtcatataaacaaactgaaataataaaatcagtaaatgtgtatgggtatacagttatctgatactataagcaagcatccttctgttgctatacagatcctagatgaaagaactcatcctcattcattttgagtcctacggagtcagcagtaccaaactccatcaatcccttattagacctcatcatcttccttccagtatgcagatagagcttattttacaaactaagcctttttcttgagattggtaaatattgtttgagcccttaagcccttaattttcgcatctagcctattgtccatagtctgaagagggaaagcaaacattaagatataatcaaatttaattttgtgatcaaaagatcagtgttctatgctccagaaaatcaagtataaaaggaagacatttaatgaatgctcaccaacgtttctgattcttcttctcctaggcctattatgtaattacatttccatcccctttaggttgaggagaccagtactttgattagtgcaatgcaaggagaagtgtttggtcctttaacagttagggctccattcaccacattctttcccctctgccatgataaccagtgacatttacagatagtggaggcttcatcaccctcggcaccagagagaggatgaggtggaacagtgtcccctgccaacccaggatgggcaggtatcaaaaaaattaaataaacttttttggttctccgtcacggagagtttagacttgtgtgatactgccacacagtctttcactggattcatacattcggtgaaactggtgggcttagaaatgatggttaaacatttcttgagcatcagaggggcaggaaatttaaattactagaaggtaagcttccagcctctgaacatgtatcaaaaacaagtgaaggaaaacttatctccacacaaaaccctgaacactagtagcagcttcataaataattgtaaaattttggaagcaaccgaggcatcttttaataagctaatggataatcaaactgtgttacatcccatacaatggaatattattcggtaataaaaagaagtgagatattaagccacaaaaagacaggaagaaaccttaaatgcacattactaagtggatgcgtcactctgaaaaggcgacacactgtatgatttcaactacgtgacagtattgtaaagggcaaaactggtggcagtaatcagccattgtcaagggcttatcgtagagatgaaggtagggatgggtgaatcacaggggagttttagggcagtgaaactattctattgccaaaacccatagaacgtataacacaaagagtgaagcccaatgtaaactatggacattagttaataacaaggtatcaatactggttcatcagttgtaataggtatatcatattaatcaagatgttaatttaagggaaaccaggggagttggaagagggggtatctggaaaaatctttgcactttctgtttagcttttctgtaaacctaaaactgctcaaaaattcagctagaaaagcaaataaaggatattttaacttaacaaaataccaaagatccatttacgtgattacaaagtgaagaggtaagtggtggcaggttgttgaattgagggttggtctggtgggcttaattgtggaatacttcgacgcacacaaagggtcatacatttggatattatccagaagaggacataaaaaaaatgaatgagcttcttggagagaagagcataaaagactaaggtaaactgtggtaagaaagaatagtcttgagaagtaattgtaagtgattttgtcctcatgaccagaaatatgccatcctatggacagaaataatactgcatcaaaacactgcttaagcaagttaccctgcaggaatgttaattccagtatacatttatttggtaatcagagataagtaggagagattcacttttgtaatggcaaagccgatctttccaaaatgcctcacagtggaaaggaggtttgcagtgtgtgaggaaccctgctaacgcccactcaagtgcaacaatataactggtaaaaattatttaaaaagacaaaaacaaaaaaacaggccaggcacggtggctcatgcctgtaatcccagcactttgggaggccaaaaccggcagatcacttgaggccaggagttcaagaccagcctggccaacatagggaaaccccacctctattaaaattcaaaaattagccaggtgtggtggcgcacgcctgtaatcccagctacttgggaggctgaagcatgagaatcacttaaacctgggaggcagaggctgcagtgagctaagatcttgctactacactccagcctgggcgacagagttagactctgtctgaaaaaaattaaacgaaacaaaacaaaaccaaaccgtctgttttgctaacgtgatatggcatacgaagaaacagtaataaagaaaatttcttaaatctagataagaaaaatgagagtccatggcactagagccatggcctgctcctactctccctcacagtttaatgtgatgaagctccactcaagttgggtgtggccaggaagatgaggttctccctcctcagcctctagttaaggatgacggtatctctttgggattggcaggaatttctcatccctgtgaagctccatgttacaggggctaaattccaggcaaatttctttggaaatcaggggctgtcttcctctacccacccccgccttctcttgcctccactctaggtgtgccaggccaagaatacttgagtgtcattgccttcacctctgctcactcataggatagaggttccccactggaaaaacaagctgaaaagaccagaggcaactgtctctacccagctccctgcttccaaagcaggggtgtcactctgcgagaagtaggccactatctctgtccccagatctcaagcagtggctgagaaattttgcctaggggatgtggcaggccataagaacaaaagggcatattcttttttctaattgctaaggcaatttgggtacctaggcatgatgtttgatggtatatttcttaggttgctatttggtttggtttagaggggggagaacgtggttgataaggcctcttatctctctgtagtccacagtttcaaatcccaattctaccagtttacaaccttacccaagggggaaagatgctgagaaaaacaaattttattttaaatatgcagactcacaagaaacttcctgtcttccatgagagtaaaaaagtacgactatcctctatatagttaggttagaagtcttcttggtttcctcaagctagaaaggagcttataggaagagaacagcatagggaagatccccctttccttagcaaagctagggacattgtaattcgaacttctctgtcctcctgctaaatacatctagctgtctccatggtccttgtaagtccatagatacccacctgaaaatgccccctttatttgagaaatacagtcttgaagcatggcctcatattggacagagatcataatgagtcctctttctcagtatttcttggtgagggaagagggactattccatccccactgtaaacagatctcctcatcctggatatgctctatatttacattgttcagagccatctggaatgatctagaatataacaagagtgatatcaacccagaccttactttctctctttggggtggggtggggataggaaatgaggtttttgaggagggcaaataaaatgcaatagttaaaaaataaaatgttgattacattaatttctggcatcagaataaaaggaaatcataactatcagcacagctccccagctactcgggaggctgaggtaggagaagtgcttgaacccaggaggcggaggttgcagggagctgagatggcaccactgcactccagactgggggacaaagcaagactctgtctaaaaaacaaaaacaaaaacaaaaacaaaaaatgtatgtactaggcactcactgaatgtaagattaagaagatgcactttcttgccttcagaaggaatacaaagttacaaagtatgttgttaaccattgtaataagtgcaataagcatttggtatttcaaagggctgagaaacacactctgtccgacaatagtgaattagggagggagggcttctttgaggaagtaaatgtgttaggtttgaaagatgaacaggagtttaccaggttcccaatgagcaaaggaaggaagtattttaggcagagaatgttacatgactgaagtcactgatgccaagaaagcaggagcactcaggaaatagtgatacaaagttgatataagagataagcttttgttttcacatcaatttaatacacttttattaagcacccaccgaatcaccaaaaacctggtggtttggtcttcatagataagttgccaccctcaaagccctctactgaaggcgcactcatgctacgtgccaagttcataagtgacactggtttcttgcatttccataccgccacggacccggatttccttggggatctgaaatagcctaatgctaattccagcttctatgctggtgagggtattatcagcaaggaattagttgaaccatactcagcaggagagtatattctctgctatgattgattctggatagttcagaagaatgcaatcctatgaaacatgatatattcattggctaattttcaggacagaccatgaattctgatcccaggctcaccgcagtactatcgtcagcttccctgataaaagcaaagcttctgagatgctcttgctattgtttggaggaaggtatggttcagcaggtaattaggtttttattggcaaaatctgcaaagttcccattctcgttttaagaaccagtttctcttatcaggactttcctagtagagatcatatttctgcaggagatttgagaaggcagaagggagaatgtctgacctggcccagatagatcatgagccctaggctagaggtgactagggaggctgggacttgcctcagggacgtggttgcgcccctacattatacattacttagtttccttccagacagggaggggagcctttcatttttttgtttgagatcacctttcattcattctctcatttggcatacatttgttgagtaactgctatgtatcaagatatgaaccaggtggctcatgcctgtaattctagcactttgggaggctgaggtgggcagatcacttgaggtcagagacgggcatggtggtgcacgcctgtaatcccagctactggaggggctgaggcaggagacgggcttgaacccgggaggcggaagttgcagtgagccaagatcgcaccactgcactccagcctaggggacagagcaagtctctttctcaaaaagaaaaaaaaaaaaaaagagatatatactgggcactcactgaatgtaagattaagaagatacactttattgtctttaaaaggaatgcaaagttacaaagtatgttgttaaccattgtaataagtgcaataagcatttggtattgcaaagggctgagaaacacactccgtcctacaatagtgaattagggagggagggcttctttgaggaagtaaatgtgttaaagttttaaagatgaatagtttactaggttcagaatgagcaaaggaaggaggtattttaggcagagaatgttacgtgactgaaggcactgatgccaagaaagcaggagcactcaggaaatagtgagttcttatttgggaatgtttgaatatggaatgattggtgatgatgcacagaatgctgttagagggtaggagaacgagttgaaaaggtgaaaatgcaggcagagccagaagtctaaggagcttggaggacacagaattaaccccatgggctcacactggacactagtagttgtatcacttttgttcggctaacacatggatttttcttgttttaaaaatatttgaactagaataactttacctcctccatttaaggtagagccaccccttcctacagtattccaccagaagccttacattctttactactcccccaggcccctaaagacaagtgagtgtgcaatttcatgagcaataaaaagtcaccagaggattttaggcagatttaacagatttgtattttagaatgattgctctagcaatagtggctattatcacaactgggaaggggaagcaggcccaagtagatgctagagcaataactgaggtgagacatgataacgctctgggttaaggcaaaagatatgggttgtaagctacagattaggaaagtcttcaaaaagtggctagcgtaagaagaatctgctgaggaccaacatttttagaaataagcaaattcccaacaaagggatagaagaacaaactggggagaatggctgtatactgaattcaagattggggcatgttgaaatttagctaataggttgacaagctggatattcatgagtggtaggaaacagaagacaactagacaattagaaggaacttggaatacagtatgaggtgcttgaagacatagggatggctgtttctgctcaagatgtaatgaaggaagagacagctgtaaggcagaatatcggcagttatgggaaaataaatctgttatgagaccagatgaaattagcattaagaagagaactaggagacactgggttgtgaaaaccaaagagaaaaatgggtcaatggcttgcccaggccagaaatgcaagtagaaggagttgctgcttctgactcaggcctgcctgttttctgagtgatttttgattgctacactcttggtatatatcatctataatagtcaaagtaggccagaacttcacccttaagcatctcagtctccccagaacaggcctttccagagtgaactacaagcaggaaatctccccttcagagggctgtctattctttggcaggtagacctgactttagtagtaaaggcacaaaattctctgggatgcaagcaattccaaagggatctaaaagaccatccctgctgcttactttggaaagattatcatgattatctttattagcacagaactatgtaaagtgaggtagattttattatggaggtgaaagtgtgggtaggagcaggtaatcatgcttgagcccactaagccctaaattcatctaccctctctctggtcagactatccccagagtttagccatgtgtaagtccccattcttgactccacttaggagataaaaatctctttgtggatgttgttgggggtggggaatggaagcttcccccctgccccgacattgttgtcaactgtccttagaaaagcagaaaagagcaaagagctctatggacaaaagcccagatttttatggacacagggaaaggccactgcagctttaaagaaacactttctctgttgaagtggggtcggaaatgtaatggaagtaggtagcaaactcaaaggtatggtcttgtgagaaaaagtatttatttgttataggaaagcaatcagggaaaagggagagaaaggccttcgctagagatctaaagcttattgatcagtgtgtgttacagcattgaacccactggtattattcccatactttagtctctcccacagactggattgagcccgtttttatccacattaggctatcagcactctaagtgcttttctaatggacatttcccccccaaaagtaaggtaattgaaaggagaaagccatgatttagaagttgcggaagtggcgaaggtttgtattacaactttggtttttgaaagtgactacaaaattatgaaggggagagaaacaggatctctcccagtttacctaagcatttctatatactcaaagacaccactgtgaatcaaacaagaacataagaaaactcagaagacatgggcagagaagcaaaatggccaggtacgatgtaaaatgtaatgaggctagctagcacatccaacctggtgctaaaagtcttttaaggacttgaagctagcttgtggaaagatcagctattaatgtttgccagaggcaacccttaggcctttagagaaaattgtagttttccaatgataagaaaattaccccatggttctattcttgaattattttatcaattagctaagggaaaatacaatctcagacaatgcactgtacctgcactgcggctctattgtgtggcatcgttcacatagctttccaaaaatgtgggctatgacaactataaaacgttaggtcattttcttttccagatgtgatctcagaggtgaatgtttctcagctgaagtgaggaaaatgaatattccaaaaggattgcagcttttcttaaggtttggaacacataccaatgaagtttggtaaaggcaacagagggaaagcaggtggttgtctaggactttgtgtcaacataaaggctgtaagaagacttttgaatgtctcaaaaattctcttctgactgcaaaggtatactatttcaaaatttggtttactgattaaaaggtttatatgcgtacttttagacactcataagaggacatcaaaagtgcaacagcacctccccaggactggaatttatgggactctatttcctattattcggcctccaactcaagtacataaattttggcttttagagtgagagtctttaacttatttatgaagatggaatctgaaaaatgttgtagatattgttgtgccagccacttatagagaattggagtattaaatgatgctaaatgatgccaaaagcttcctctaccaacccttataaggtgaggtagtattagatacaagttttatggaataaacaaaaaaattaccagtatgcttaataatgaacatttaaaacctgtttcctacagccaaacaggtcatagttgagtgataccagtggtaggaaaataaatttcaaaattacttttgttgatgattttccacactaacaagcttgaaatagaaccttatatagtatgtgattttaatctgaattgatttttaaagaccctccatattaaagtcacaggcactattttataatcaagaatagctaactggtgcttctcttcataaaaatccctcctgggcaattcactacttgatgcacttgtcagggtttttcaccatgtaaataaaagaagacatggttgtgcatctctcattctgttattatacaaatagcaagatgcaatttttcaacattttaataatgtagaacagcaggaagtatttttattacttgaacatttttagacatttataaacctattaagagagaagctgcatggattacaatagacctatctgggtcccaggaaacagaattcctctttgggaaaatgtctttctcataaattatcattatttgtaaaaataaaaattcctaagctgttaagtttacctgggtacaaagtttttttttttttcttggaatccactggtctctaatacttattgagtatgtatgttgcttatcaattactcattacctatacacatacagcatatatttaaacatgtaaacacgtgtatatacatacacattcatttttggaaaattattaaactcctttttcttttatttaaaataaaccacacccattaaaaactggataaaagccttctgataaagtcttatcctaaaatgaagtgtgtatgtatatacatatagtcaacattaattttgaatactgcacaaactattttctagtttaaaaatttacagtgatcaactagttacacactgaatcatgggagaaaggccataggctgattgtcactttgagttatgccttaattaccctgtttctagtgcactaacttgccagccaccttcttttttgtcccctttatttttctaagaagggcaaaacatccttgaagatcactgttatattcatagcaatgtgttttacgtttatggaaaacctaaaaaccagagaaagcccacaaaataacagtcatttcaaaccagagacaatgcattttttctcatttattcaaattcactgcaggaagtaaacactaaaagattaaaaaacaaaacaaaaaaattcacactgcagtatgtacagtttcatgacatcacatgaagaaattaaatttctaataaaaatggcaaattatattactgagcagatcgcatcaaatttggttgtgtaaacaccagaattcttactatgaatggtaatgtgcctatattccagtattgctaatactgggatactcttggaataatgtttgcaatgggattaaaaaattcatgaaagtagttgtgtgaattctttatgtttaaaagtggttgacgattaaaaaaattctttaagacccttcgaatcaaagcacattctttcacaaagcttaaaccacagacgtcatgtccagaaatggaatactgtcatgttaggatgaacatctgatctgatttgttaagacattttgccaaatgcacagatgcacagggtcccccatgcacttttcatgcagcaggtaatcacaacttaaataaaaggtttattctatacatttgtccagacttgcaactgtatacatacatgcacaacttttaaacctgtctgattatatttacacttatacatggaatatacaggaaccaaagagattaaaaggcttttctgttgcattagaacaatacaaaatatgtatttttcattaaggaaatcactatttacatcacctttaaaaaccgattttaacatcttcatgtaacaagtcaatatatatatatatacatattatatatatatatatatatatatatataaaatatatactctcaccagtttactcttctgtaagatgcagcagagaataaacaggtaatgaatgctaccttactgatgtcaataagctgtagtaccctttcacaaatgactttattagaagaaattgtctagatatctaaaatagtccttgaaaatgtgtatatgtgcatccttgtatctacatatgcataaacaaagtgaatctgtggatgtatgccctttctcactgttctttaaaatcaccctaaattcaaattgggaacattctctagtaaatcagaacagcattcttcgtggtcatgtttatttaagtattacatattctcattcctttgttaacaacaacgaaaacaaccagccaaccaaaaaaacaaaacaaaacccacacacacacacacaaaagtagcaatgctggcccttggtcttttccctgacctaaatttcactctcttgtaaaaaggtcatttccccctacccaagggagaataccaacatattttttctgacatacctctaaggctccaaaccttccacaacgatcaagaaaaatgacttgtttaaaagcttatttatatagtgttgacaataagattgtcatagtatggacatggaatagaatatattcaactggccagtggaattttatgtcagaataagcctatgccttcacttctccatgatgttgcataatacccactcctattactgtataatatttccagtagctatttacaaatcattctgaggaaaaataaccatttagggttttagatcatattaggaaatcacacctatttttaatataaaaatcttagaaaccacttcaagtagaacaattttaaatcaatatcctaactagtagtgattatagaataatttttgataggtcatttgctaacctggttcacaattaagaacaaaatatctggtgaatgaattgtggattgtacaaactgaacataaaaacagacctgtttcgcaactgaaaccccatgtggcttcactaatatattaatttcttctaagacagtatcaacatgtacttttcatcactactttaaagtaaaagatccaatggagtgattgtgtacaattctgtcacgtatatgtgccctttgtactttttatttagtcaatctgagtttagtgcccttcttgggtttaaactaaatgttgtaagctttgttggcattgttcttaggacaatggttttaataaaggttaaggatgcattcaggagaagtttccaaaccatcctggaatcacctgagtttggtaagtggccctgtttttccatccctaaggctaactaagtagatgttactcattagaacacacaaataatcacagattttcctgagatgttgagccagatatgaaagttatcccctccacccaatttttgtcataaaaagtgttctgaacccgatttccaaagacataacggtaatatatgaactacaatattgcaaattttgagctgatgtgtgactgtattggggaaaatagaggcatcacatagttttttgtttttgttttacagtctcatgttctgaggaaagtcataagtcatggttctcaaacacaagaaacacctagagagcatgttaagatgcagatggaagattccaggtccacttagcagagattcttgttctgtagatctgagatgctgcctatgaatctgcattttaaaacaagtgctccagatggttctaatgcaagtggtctgagttcaggtttaaggaatcctggtcataacactcgcaggtaccacaggaatggtgagaattaacttttacaagagatggtgaaaactgtccaaagaaaagccattttgcttctgttaaaaacaatttcttaaatattcaacttttcaggaaaccacctaaagataaatgttaacttttctaattctgtaaaaggaggagtattaatttagtaaagtagttaaaatacaaaaaatggaaatctgccttttttttaaaggatctatcaaacttccctcaattgtaatcaatttttactaagtagcacaaggtttaaagaaatatatattgaaaaggatcagggtgggacagacacattgggaaccacaaaacctcttccaagagttaaaaataaacaccttttttttttctttttagcaaaagtgaaaaatgtaagcatatatttttctaatttatttttgaattggataataagctgtgaatcagcactaggtttttttttattggataattatcctttaaagagttgtttaacagtttagactttaaaaatgtgttatgtaggctgacttctgaaaagcaaaataaagtaccctaataaaggcagcaaaatgcattaatccactatgaatggagttttacattttaatttatgcctaatatttataaaagaatttcattcataggctactcacagttgttatctgatgcatacagaagtgttaaacaaccaattgctagttcagtagtttcctcatgacatctaatgttaagcaaaaattagtatgcatatttcaacatcaccagtaaccaatacttttcaaaatgaaaaaagtttcaattataccatgctttttttcaaatcatgctcttatttatacagatctcaagttcatactcattagttttaaaaagatccaaaactggatggcaggtacattttattctgattctttctttatcgttagcacgcttcccagaagtccataaacttctccatttgcgctgtgtgggcgagaagcattatttcccatatggctattgtaagggcttcttaaattaaagaaagaagctttcgtttctgcagtaggaagtaactcttctttggctgtgacctgtgagacactttcagcagatgaagcctccctccaaatgtccttgtcttgtgtttctcgactggtaacagaattgcctcctttttgaagcatgtaatatagtattgggttggttttggtcaatcttggagagtctttttcatactcattcttctccgcatcagtgataacccacttaatgggtcctttctcactgggcatggaacacccattcaaaagcccagattctggtctagaccctgcacagcccaagtgctcagggaaagtaggactcacaggagtttttactacacctgggtatgaaaatgtcctgttatccatgcaactgctgggctgagtggaactgtacatcagtccatttaaagaagaaatgctaaattcaggtttgctgttggtcacattatttttgtgtcctttctttttactgtcagccacagagttacttctgtgcggggacaaatctcgcacacagttttctgagagaagcagctgtttcagaacattaaagcttttgctctctctggcccaactcctgtgttcactttcgctggctgagccatgaccagcaggatatttaaattcaagatcatttctgctaaatttcagctcttcctggttaagcaaggacccatacagtacttctggggcactgtgattgtttgcagcatcaacaatgttgtttttcatctttttaaatggattttctaatggctcagtataaagcttccttttcttagggaccatgcaaagattctttgattctagaagtgccatttcattatttctgtgactcctgtctgaatcatctgccaggtaactatcttgattttgtcttagcaatcgacttagcagaccattcttggagaaagaaaaatcctgaggtgaaacaggctccgatttaaagtcttcggacactggtaaggcaggtgcgcttctctgcacagcaggagccatacccaagaatggggcactcttagcatcatggctcaagtgcacatttgtgttaggaatttgtaagtcatcacaaggctcagattttattttcaccatcagtatttgttcacttaaagctctctctgagtgttcctgagtactttcatctcttaagggagttttctcttttttttcactcttccctttgttggggttccccaggagcaactggaggacagtacgtctttcaagcagattttctatttcagaaccagaaagccctggttcaggacctgttggttgactactaaatgctttattttcttcaactgcatttgttttatttgagagcaaagggctatttaatctatcaatcatacctatcggtttatctgtgtttccagttaacagctgtttgctgggtctctgctcttccactgacatggatgactgcattccacattgtgctaaattttgtaacagcttactggcactaaacgttgcagagttctgtgcaccttcattttgggctggtttctctcctggtgggtctttgctttttgtaaggtccattgagtggttagatgcagtatttgttagcttttcagactgagtactgcagacatatggtggggaattccatttgatgaccagagagtgttgagagagattgatgggagaccctgctttgcttgatgtaagtaaaggtggagtgctcactggagtagtccgatttgtactggggctttctatcacagaagtccttgcataattttgtgtattgaacttgctcacatcattgtgtactccctgagggctggtgtttttttctacattttcttcattcttatggccaagtagcaattgaagaagtgttactttctggtgtgagtttagcttagaattctttgaggtatcttgatcttctttgatatctacatctgggacttttggatcccaagtgtttagcaaggattgagtgaagttatccagggaaacaggttggtcagattctgatttttcagttcggtgtttgcaagacaagtctatgggaacacagttggaataagaactttcatcaccactgctgtcatctgtaaaactaggattgttatctgaatattcatcaatagttgtaggtgtactactttcctcaaaaatgcttcctctctcactgtgactgtgtccattcattggcttaggtatagtctggcttttaagaagatgtaaaagcaaactattgttagcagcttgttttatattgtttctttccagtgagttcttataacctgcatttttaggggaagaaggaatgatacccattggattttgaaacactgtagcactacttttgctagccatcagtttgcttgatgatgttcttgcctgaccattaagatggcttgacattccttttgggagctggtaactgccaacatccttctggccattttcttgcaatctggccatagcagcaagtctttcacttgctgcttgatttgcattttgcgtttttaaagcgtgttctcgagaatactgctgcaaatgggcttcgcttgacagaagtaatgctaactggctacaagcaacactaggtttaggtgaggtggcaggactagcccttttttccaccatgcttgcaacagcctgtaatcttgcagcacatgacaacggttcactcatgacctttgttccactttgtccaacatgatgaggagactctgcaaacctatctctgatgaggtttttagtcacatcaggaagattcgtatcaggcttttgatctttaactttacttttcttcaacaaagtttttaagtgacttgatgcaacaccatagcaccttaaatccttctccacttttaaagaatcatgactgagggcatatccttgctccttgaggctctgcctgatttgttgtgacagagcaacagtctgcagcctagagctgaatgactgaagcaaagaggccagtaatgtgctatcctgtttgcctttaggcacactgtcaaccatgccagctagcaaagcttccttctttacgtttaaattcatgatagaatcagacagcctcttccgctttgctgcattccagtcctcagaagactgcaacagtctggcttttttgaggtgcagcatgccagacccctgatatgtatgtgtattgagaactggaccattactttgacaggtgggaaatgcactgccagaaatgttaaagttctgatcctcttcattatgcccagcagactttttgtcaacggcagtacctgatccccctgctgcctgatgcattagtaatccttctaggtaagttaaaacaatagaatcctggtgcacatcagagccaagctcttctccatgagtcatgttcaatagaagtgttcacaagggcttggtttctattcactttaaagaatggttttctgtggtgagtgcgatgtaactttaataaaggagtatcagtttatcaccttccatcgcaatcagagagagacgtactgttacattctgtccaagatttcttctggcaatgacaagataaatgcagtctgaccacagtgctgatcaacttctacgcaaggaggaggagaagaattccttaacacataggtctgtagcagtaagcagatagaatccttagtgaatatattccttttccttcttcatcttttgttccccattaaatgcaaatatcagtgttctaaaaaaaataaaaataagaatagttaaggaggcagaactagaatcacgttatgatacctacaagcaaaataatatagcatctgtaaatgtatatatatattacatataaataatagacatataaatggattatagtcactttagtaatttgttttattgccgttcctattcaattgaaaatgtctactggaaatcctgtgggttaatgcatactgttaaaatgatcaaatcattagagaagagaacatactttaatgttacatagccatcttccaaagccgccaagtctctgaattttcataagcacctttctgcaaagtaatgtgaatgttcagtctcctttatagctttatagctctacaggggaactagaacttgcttccttacattactgggcacttaggaagaaacaaaagtagatgtgcagaaaaaggaaaagagatgcagactctgatgagtctgatgtggggttgaggccaacagaacagattcatttctgacatcatcccccaaacaccagacattccataagtaatttttagaatttccgttttcaaaaaaatgaaaccactaacaagttgaagattattttgtgagtctgttcaaagtgtgaccatcttaatcatattcataaacattaaaatacagtcataaacttacctacccatactttttaccatgacttattaaagacagagaggagtgattctttagatgcttgttcagggctatcaagggtttaatgtagttcgttagtaaatccttactcatgtgctctatggagaagtcttaatgtcaggtccattccttacagatacagaagacagggagggcataaacatatataaaaagtacaatggagaatgccaaagacattttagtcacagtttgaaaaatattccaatgatatttattatctaagaagagaccaaaaaatttcctatcactaacacatacacaacagaagaagcaagaactcattgcatttctgaaaacttgataggtaagtgtcaaaattgacctaaggaaggggggccatgacacctttggaagagaagctggaataaattccatgcagtttgtttttcaagatgccagaacattttgtttaagttatcagacctgaagctatcaacaaataccttggtccctatggaatttaaaagataaattttaattgaaagactaccctgtagctttttaagtacaatgcttaactctaagtcaaactttaggaaataattatctgattgtatcaaattgttgaatttattgattaaaaggataagaaatgatagccaaagaaaaagatacagaaaggaggcagcaacaattaatttcaactgtgtaaggagtaggatgagaagagactttcttgagattccaatgccaccattttaagaagctttgccataatgtacttaagatggatattttaagaggttaataatgatatagaaatgaaatggttatcatgactgccaccaaatatccattctcccattttcatttactaataaaaccctgacttgtttttcagggagtagggaggtatcccagctaaacactacttttctcccccctctggttatattttacaattgatggcatgttgcttaattggaggcttatttttctttcttagtggtataaaacatacgggtacattttacaactgataacatcttggagttgaggaaacccagttttctaattctctcaaaaaacttaatatggccaggtacggtggctcacacctgtaatcccagcaatttaggaggccgaggtgggtggatcgcctgaggtcaggagtttgagaccaacctgaccaaaatggtgaaaccccatctctagtaaaaatacaaaaattagccgggtatggtggcatgcgcctgtagtcccagctactcaggaggctgaggcagaagaattgcttgaacctggtaggcagaggttgcagtgagccgagatcgtgccactgcactccagcctgggtgacagaatgacactctatctcaaaacaaacaaaacaaaaataacaactgctaatatacaattaattctcaactagttaagacatttaacaaccatttaatgggatatgcaagtccactgtatttctctccacaccactgccaacctttttgctcttgggtagactcaagaaagtcaaaatcataccagtcatttgaaaactggtttgtaaacagccataaaacatactttatttaagaataagaatgaaataaggagcatctttgagttcatattactcctgttattgctttctactttttactgtgcatgatataatttgcaaagtattattcattgctttaaaaagactgaatttacacatttctgaatttacaaagcagatttggaagttgatttaaaaaggaattatcacagtttccttgtaaaggagctctaacactgtattttaccatttatttacctctctaccatttatttcctatcttcacagagaaagtagatgacagatattaagaataatcatctcttaataatccattttttggcaatcagctttctcaggttgaaaatcatttcttacatatgaaaacaatttttaacttcaagaacgaaaatgacatatacaaataattttattaagctccttgggtctgaggactgtgctaattataattactacagtgcaacacagtcaacagataactgaaccttgggatacattaagttattcaatgaccaaattcccagtaggaaggaagggaatttgacattcaaacacacacattctctcactctcaaaaaatatatagatgagatactaaaataattcgaatcacaaatttgaaaccacacactgtagttcatcacttgaaggaatcacgaggagaaggtcattctaaatattcaattgtttatttcatttaaatcaatacaacatattcttactgaactcccaatctgcttcaagatctgtcttaggattggtgaattatgttcatttttaaaaagggatgtgatagacaacatctagagaaacaggcaaggtgaacatccacctttaagtttctagaacatctctaataataaaaatatcttctcctcatgctacttcttttcacattttcacatgactcttatatcaccaagcacaaaaaaattaaaaaatgtgatatgaaaaatcttccaaagattgttttaagatttttaaatgaaaactataaaacaaacatttttagttcagaaaatgtggttaccatagtatggataaaagtcactatgtgtatgcactaagctttcacactttcttctagagaagtggaccagtaacacatttagaatagatttaaaaggaagatgaataattgcttccaaaatattctaagtcaaggcagttatttttcattaatttctttgaaaaaaatcctataaaacgtaccaattacatgaagtagtggagaaaaaggattttcttatggagacctgttttttaaatgagataaatctgtaaatcaaagattgtggtcacgtggagaggctgcctcaggtgacacagcagcaacacctaccactgttctagcagaaaatgaagtgtctatcctaggaaagcaggaattcttacaccccttaaggcctgaacgcacttagctccttctattgaaagctcttcagggagcagagtgagccaaatttctttagatatcttccttttctatctcttaaactagagagggagaaatcactaacaatccttctcacctttcccaatccttgccttttcatttctatagtatagaatataattgagaaatatagcaaaaaaagaaaatgaggcacgatactaaatagtacagcttgttgggacctatggatttagggtattaaggtaaaatatgaccactacctaataaatagacgttttaaggttaaaatgttattttaagttattcaatattagcttaactcattttcttttagtgaaagacaaccacattattcatgaaattccaacatatagttctcttgcctggttttatataaatataacttaagaatgttgccaggtgtattcttgagtatatttagttaccaatacctaaaagtcaacacacatttaataattaggtttctttagagcagcagtccccaacctttttggcaccagagactggtttcatggaagataatttttgcatggagtagcggggtggagatggtttcaagatgaaactgttccacctcagatcatcaggcattagattcttataaacagtggggaacctagatccctcacatgtgcagtttacactagggttcgcacttctatgagaatctaatgctgccaccgatgtgacaggaggcggagctcaggcggtaatgcttgctggcccactgctcaccgcctgctgtgtggcccagttcctaacaggcttggcctgggggttgggaacccctgcttcagagaattgcaattaatgtatattttgaaactggaattgtttataaaatattgaatcctctggtttgttattttcttaattttgatggtgatttcattagagcttgtgcatgtgtctatttaaagttattaaacatttgcatcacagtaagggagagactttacttgtatggtatatacttgttaaataacttctaagtaaagaaaacagaacttttctagaatttggcttatggcggatgagaagaaccaaaggaagtaaaaatactaaagggacagaaaaagaaaaaaaaaagggaaaaatactaagaacaaataaaggcatcatgaattctgcaactctcatgaggtgccagaaggaaaaacttagtttacaaactaagtagattatattactagcctgcctttaaacattaggttggtagatatgacatgcaaagtgaagaaacatcttttatgaacactaaaaatgcatatatacaacgagaaaaaagtaaaacctacacaataatagaataaaagctaactcagtgatgtttgtttcaacttggctgtcatttttatagagtggttccataaaattttgaggaaaaaatggttaattttaacaaaaaatttagtataacattcaggataccaagaagtactaaattttgatttcagtattatcgtcttaagtgaaaatcagctcgcataattttttttttttttttgagacaagttctcattctgttgcccaggctggactgcagtggtgagatcacagctcactgcagcctcagcctcctggactcaagggattctcccacctcagtctcccaagcagccgggaatacaggtgtgtgccaccatgcagagctgattttttttttttttttttcctgtggagatggggatctcacaatgttgccaaggctcatcttgaactcttagcctcaagtggtcctcctgccttagcctctcaaagtgctgggattacaggcgtgaaccaccacacctggctcttttacaattttagttcattttaaccctcagtacaccaagaaaaacagtcatcatcatttatcatctgggtccaaaagacattttattaatatttaagttaattcatgaataatttacacaataagaataaagaaatgacacaaaacaacttcactgattttttttcataagaatttaaacataacattgtaattcaattcttcattccctgttttcctggttttgaaggagtatatatctgaaaaggacaaggcgctttgaaactgacagctcatcaacaggttcatggatgaacctggaaatatttataaatattgattccagatttcaggtatgtgtttaaaaggactcttgggtcttcttcttgtacttgaagaattcaaaatgtgttacttttgataattttaatagctcataatgatgttgaaaagatgacagaaatttctgcttcgtaattgcccaatatatttcatttttagactaacagcaattacaatgatcaatccaatgaattacttcatttctgtatcatctctttctttacaatctcctctatcaaacacctgccttaagtatctgtccacttacgaacagtgtcaaataaatttggtgttccaaaaatcataaaagatgaaagaatactgtcacacaccctttgaagaaaacagagccattgaagtttttgccacaaaacacttgagtgttgaataccgagcaatgcagtctttcctaatgaataactaactgtatgaaaatactatacttactttttgtcctgagaactgtatttttgaactatattgttactcattgctccctgtgtttgagaaaattcacctggctgggcgcagtggctcatgcctgtaacttcagcactttcagaggctgaggcaggatgaatgcttgagcccaggagttcgagaccagcctgggcaacatggcgagaccccatctttacaaaaacattaaaaaaaaaatagctgggtgtgatgttatcagcctgcagtttcagctacttgggaggctgaggtgggaggatcacctgagtctggggaagtcaaggctgcagtaagccatgatagcacctgtgcactttagcctgggtgacagagcaagaccctgtggaaagaaagaacaggaaggacgaatggatggaaggaaggaaacattcatctaggatgtatctgaagacaacagtcagtggtattgcttatataatcaatagcaccataatcattcacatgtaaagtattagcatcagtttttttccattcatcttctggtttatctaagtgaaatatcttcgtttgtcaactttcctctttgacattacagacagaaaaatactgaatcatcaatttttaataaaaacttaaaacaaaagggaaagactataaagacagtgtctccagatgttttatttttatttttttacattcttgaaagataatgtagtataatgggctctaagaaaactgaagatggggctgggtacggtggctagcctgtaatcctagcactttggaaggctgaggtgggaggatcactggagcccaggagtttgaggttacagtgagctatgactgagttactgtacaccgcattctagcctgcgtgacagaataagacactatttctttaaaaaaaaaaaaaaaaaaggaaggaaggaagggagagagagagagaaagaaagaaagggaggggaggggaggaatagaatgacggtaaaacagtgatgatttcagtattgcctcatccttctagacacttccgttatttttactttttattattttagccttttttttaaaggacagttgggaataaataataaattcattgccaaaatggtaaaatgccaaaatacttaaagatacagaaaaaataagatcactaagattccatatgtacttttgacttctaaaaggttccaatggacatatatagtaacagcaaggtactatgtttgagtctattaaggacacattcattaaaacttcaaaaatgtggtattatccttcctaccacttacaaatatattttttaaaaaagcatttgaaaactaaaactgagtccaaagaaccctgatagtataccaaaggttaatgtatttcatgataataaaattcatgtccaactacttaacaatgttaaaattataaacagaatcttccttttattaatttaaaattgtttataagcataaaaatcctttaaagtttataaagttaagattttactgatctacatcatgtggtggaaaaaatcattgtggtgaaaaagaattattttagaaagtaataaaatcaaactaaaccatgaaaaaattccatggaatcttcaccatatgcgtagattgatttggggaaagatctaagtttcaacacaaactagtttaatgaaatatctaataaaatgcttgaattacacagtatattttaaaaagagctacatttacttttttttataagtatctgaaaagtacagaactaagtgataggtaatttttttagagctttttaaataaaagacagtagtaaatactgtgcatactaacagttcacaaatgggtgctatattgattctctaaaatagctaaactattttcattgcaatatgttttacattttctgtttggaaatggtttattaaacaaagggaaactttgtggaacttctacacactttaaaatgataaaatccaagtgataaaattttacttagttaaatgaagaatgcatctggcagaattcttacatgtaggactatttttggttgagaatagagaaataatgacaacggtctttctccagctgtttttaaggattcagtatcttacttgcaattaaatactccattaaaaacacatttaaatgattaaacatctacgagttcacttggtatgccatttaaattatatctaaggactacctcatgacttccaattgtgtccatgagatctcccccaatttgttctgcaatatcaagtaatacctatttgagtactgaatttaaagggatttctacaatgcagctttgaccattaggacacttggctttgcctggttcctcaaaatgcgtaagtaatcaaagggctacttaattatgtcattcaagaataactcctaatggacaatattattatctatattccactgtggataatttcaggggtatttttatacaaatggtaagaaaaacattaatatgtttcattaaacattagaagaaaaatatctaagtacatactaagaagattccaaagtcctaattattgactcttttatttaaaaaaaatacagatccaggtattcggagaactctcgttgttctccaaagcagggctttgaaaggaagttttaaaagctgaatgagaaacactaagccaaaaacaatttaccaacaggatgtaactccaaacattttatccgaagggatgaaagtagctttccaaaccaagggccaatgaaaagttaaaatacgtaaaacccaacacttaatttcacataaaaagaaaggaaaagtaacattttaggtatgggtcccgaagtttcatttaagaagacaacagtgaatcctctattatcaattaaaaagtcactggaaaaaacatttaaaaaggaataaaagaaacattcaagtgttgacatttcacagcagggaataataagacaataaaagaatatgcctgaagtttcatttcttaaaatatatttctaattacttgaaaaaaatgaatcaaaattaatatatgtcttttaagggaatctgaattccaagataataactttctttgaagtattatctttatgaaaaggtagatgtgtggtcatacaatttaacagatgccaaaaataattatctaaatacattttgctcaactgagggcctcaacatttgaaatgagaactgaggagtttcttgctctctcccaggggttctcattttaggtgcagatactcctcagagacaggtggcatggacaccagagacaccggtgacgaaaacagctgcccaggctgctctccactgcaacctgaaggacttaattttttggcccaaggccaaatttgctcctaacttctaggtccattggctttaacttgctcgtcagctgcttccataggagtaaaatagtgtcattcacattcccaactaaaaaagactcattagagacactcctgcgggagtaactcaagcattcaacgcaaggacacatgtatatgaggacccctctaaatctaaaattttattcctatgattccaagtaatttgtcaaattatagctgatgaaaatgacaagcattttaacgagaaagatgatatgctgtcataaagttgtggaaatagccctgaccaatatgttttactgtcttttcaataaattccgggggaaggaaatggttttgaaatagccacacactcaacccacctaatgccccaaaaggtatctatgttcacaactttcttctgtagggtcacagaattgcaaacagatgtttatttaaaagctaaatatgagcttatattcaaattggaacttttgcttatctcataacagctatatactgaataaaatggaggataatcacaaagatttaagatctttgatgacacaaataaaagagacagatgaaataaccgttctggtgacagaaagaaacaccccataattgatacggcaaaataaagaagggcttctttgttttgaattctcctcagaaggcctaggtatatgaatcggattcaataaatttgctattcattttacactgcctctatagttaatcttaaaaacatttaatttttaaacaaaattaagatgaaaaagttggagattttaagttaaaaatcaaagatctagacaaaggagctagagaaagagctaaactgccaaacaatttctatttcaaaaacacaatacatttctggatgctgtacttcactctgtcttgaaaatactgacactggaaaattgttaaataaagttaattttacctacaatttttaaagctccagaaaactattacatgacagacagtacatacctatttatgattagtactaatgtctattcactaccttctactgttatcaaagaaacaatagtttttcttaatgaacacaaaataatcattaacaaattattttggcagcacataagtataagaaaagagtgtaaatacaaaattaacagagagtgtttgcttctcacctttctcaacagctctttggagtaactggtgctttctatcagttttcaagagcataatattttccaatctctatcaaaataagaaatgtaatggaaaatggatctttcttcttctggaattgcttgagtgtttatagtatatatgcagggatatcctttgagatgggagcatcaatcctactaaactcaactatggtttccccatccctaaaatagatttgacatacagacacaagcacaaggtcaaggtcacagatcagcaagaaagattaccaacagaactgatgtaaccagctggcttttgatcaaagctcctagggtttttagtacacttagacactctgcacttacccacatagtatatactctgttttaaaaatgttccccatctttgaagtcaagatcttcatgcacttcttattataaagtatgttttgttaaatatattgcattggatcaagaataagaggagaaaccagtatgtttgttttttttaatagcgacggggttttaccttcttggccaggcttgtcttgaactcctgacctcgtgatccacctgccttggcctcccaaagtgctgggattacaggtgtgagccactgcacccggccagaattgtgaatttttatgtgtttgtgtgcctgtatatatatatgcttgcacttttatttgtttgcttgttataactgatcattgccatgtgacaattttaaaattaacttaacttgcagttccctgaatagataatgctctctcataattccaagcttttgacccatctgaaactgaaattagtagtatgctctgcaatgccttgggtcacttgttcccaaaaacacagacttaacttgtaagtcactgcttcaacaaaagaagttttataatttatccatagtcttccacaacaattttcaaatcacagggatcaaaagaaactttagttatcaacaatgacaaaaacaaaaagtgattcttaaaggaatatattattaaatatattagtgcaggctagatgtggtggctcaacctgtaatcccagcactctgggaggctgaggcgggaggagttcaagaccagcctggccaacatggtgaaatcctgtctctactaaaaatacaaaaattaggtggacacagtggcatgagcctgtaatcccagctactcaggaggctgaggcacgagaatcgcttaaacctggaaggcggaggttgcagtgagccaagatcgcactattgcactccagctgggtgacagagcgagactccgtatcaaaataaaataaaataaaataaaaataaaataaatacatacatatatgcaattatctaacaaaatcatgccttttgttttagctgtttaaacaagatgttaaatttattttaagttacatttatgaaaccaagagttatgtgatcaatgttcttactgaagcattctggtcaagaaatcattttgaaggatgcataaagctgttggggtaaatttacactataaaagctttccttgctaaatcaagtaccacctgctgtagctttatacaatttgcaaactacttatgctatatgtacatgtaaatgttctcaattagtggtttttcatatttttgataaattaaatacctttgcatgaaaataacccaaaatttactatcctagaaagattgctagtttttcaaaaataaagtaaaaaagaaaaattatgtcaaattatcaaattaaatactattgaaatgacttatatgacatcactctagtcattacaggctccaaacacaaagatatctagatagaagtttccagtcaagctgtggaagagaaatatcactacagacacaattcatgagcacccagacatggtggtgatacctgtgaagagtcaataaatctgactaggtcccatcctacaggattaaggaatcaaaaccaaaaatactacatgcacaatgtacctgcagaaattctatgtctttaaattttcacaggtaacattaaagtatgtctgtcaacttggaaaatgaagctaccagcacaccatcagcaggccacttacttactttaaatggttttatttatttttattgaagaaactgcggtgcgtgctttaccctgatctcttatttgcccatctatccatacaaccaagtgtttgaagtactaatctcaggaacaatagccagtaaatgctaatctgagaaccagttctgctgttgtccaggtttagggcacgttctgcctgtgcagcagggacagtgacacatgctccttggcatggcacctgccactcatagtcagatacagacccaggttggggagactcaggaggctttagaggatgactccggtgtgctgaggagacagaggcagattagcggtctagggaatgtgggtcagggcttttgtgatttcaattgttggaccaaaaatgtttcagaacaacttttctcttaacaataaagaacattaaaaacaactacttacttcctactattagcatcatttaataaaattaaatcactttaacactgaaaactaaaatctttaatgaaaatctctcatcatttttctgttgctttttgtcttgagatagaatgatgtgtggaatagtacatatatactatattgatctcttcactatttagtagttcatttgatttttttttttttttttgagacagagtcttgctctgtcacccaggttggaatgcagcagcgccatctcagctcagcacaacctccgactccccaggatcaagcgatcctcctacctcagcatcctgagcagctgggaccacaggcacacaccaccatgcctgactaacttttgatttttgtagggacgggttttaccatattgcccagggtggtctcaagctcctgggctcaagagatcctcctgccttggcctcccaaagtgttgagattacaggcatgagccacgatgctcggtcctagttcattcaactcttaagttacttaaatctttacatcagaatttcccactgtttatattttgctttgtgttttggtctttcccttgatttcaattatcacatttatataaaatatataatttgttctatagaaattcttgtcattaaacaagaggttataaataagacagcaggggagaaacagggcagtaagaagaataaagaaccttctgcttagtgcccttccccccatatcatccttaccatcctcatcttttgaggaaaaatacatcagacttaaaaatgcatacagaatcctgtaataagccccatttgtttacagtcaagctaaacaactaggacatttctttcattctgtaagtctcagctgacaactcatcctctctttaggcagccttcactgaactccatagcctgagggtagttgttcctctctgtgactccacggcactcagtagatctttcaatcatcttgcttacaaaactgtacggtcacacgtcattttattgtgctttgcttcattgtactttgccattattgtggggtttttttttgttttttttttgttttttttttttacaatctaaggatttgtggcaattctgttgaggaagtctattggtaccacttttccaacagcatgtgcccactttgtagctctatgtctcatttaggtatttctcacaatatttcaagctttttcattattattctatctgctacggtgatgtgtgatctttggtgttactattataattgttttggggtgccatgaactgtgcccatatcacagcatacttaataaatatgtatgttctgattgctccaccacttagctgttcccatctctctccctctcctcagtcctttttattgcctgagacacaacaatattgaaattagatcaattaataaccctacaatggcctctgtgtgttttgcatgtctcacactttaaatcaaaagctagaaatgattaagcttagtgaggaaggatgttgaaagccaagacaggccaaaagctcagcctcttgcaccagttaaccaaattgcaaatacaaaaaaaaaaaacaattattgtaggaaattaaaaatgtcactccagtgaacacatgaatgataagaaaacaaaacaaccttattgctgacatacagaaagcttttgtggtctggatttaagatcaaaccagctattacattcccttaaaccaaagcctaatccagagcaaggccctaactctcttcaattctatgaagactgagagaggtgaggaagcggcagaggtggctcatacgatttaagggagaaaacaataaaactgcaaagggaagcagcaaatgctgacagaaaagctcagcaagaaaagccagaagatccagctgagtgagataaatgatgaaggtggttacactaaacaacagattttcaatagagacaaaacagccttaaattggaagaagattccatctagaaatttcatagctagagagaggtcaatatctggcttcaaagcttcaaaggaaagactgactctcttggtaaaggctgatgaagctggaacttgaggttgaagccaatgctcatataccattccaaaaatcctaaacccttaaaaatgacgataaatctactctgcctttgctacataaatggaacaacaaagcctggaggaaagcacatctgtttacaccatgatttgctgaatattttaagcccgctgttgggacctactggacaaaaacaaaaattcctttcaaaatattacaggccatgtacctgtacactaagagctctgctgcagttgtacaaggagattaatgttgtttttatgcctgctaacacaacatccattctgcagctcatggatcaaagagtaattttgacttcatatcttattggaaaaacacattttctaaggctttagctgtcatcaaaagtgattcctctgattggatctgggcagagtcaactgaaaagcttctgaaaaggattcaccattctagatgtcattaagaacattcatgattcatgaggggaggtcaaatatcaacatttgcaacttcatggatgactttgaggaattcaagacttcagtggaagaagcaactgcagatgtggtagaaaaagcaaaagaactagaagtgagcctaaagatgtgggtaaatttctgtaacctcataataaaacataaatgaatgaggagttgttgcgggtttttttttttttttcaactcctgagctcaagtgatcctcccacatcggcctcccaaagtgcagggattacaggcatgagccactacaccgagcctgaggagttgcttcttacacatgtgtaaagaaagcagtttcttgagatggaatctactctggtgaagagactgtgaacactgttgaaaaaacaacaaaggatttagaatattctgtaaatataaacttagtagataaagcagtaggaggtttgagaggattgactctttttgaaagaagttctcctgtgggtaaaatgctatcatcaaacagcaacacatgctacagagaaatattccatgaaaggatgtcagtcaacgtggcgaatttcattgttgtcttattttaagaaatcattacagagaccccaaccttcagcaacctccccctgattcttcggcagccatcaacatggaggcaaggcctctaccagaagaaagattatagttctctgaaggttcagaggatcattagtatttttttagctataaggtatttttaagttaaggtatgcacattatttttagacataatgctatggcacacttaacagactacagtatagtgtaaacgtaacttttatatggactgaaaaaccaaaaaatgtgcttgctttactgaggtattcatttcactgcagtgtctggaattgaacctgcaatatctctgaggtatgcttgtgttttggttcgttaaggcctggttccccatgagagtataaactccttatgggcaagaattatgtctttttcatctttacatcttagcacctagcagaggcagcattcctagtagaacatgctgtaaacagcaagtaaaccttttggagccttggtctgcaaaataaggagtgggctgtcataattctatggaaataggagaattaaaatgatatgacaatgttatttaaaatgatggtttcagatccaatatatctttttccctggaatataaattaataaaaaggcacaaaattaaagaataaaaaagtattttatcctacagagagttctgtgggtttagaaaacatgcgtgactaatattatggtagaaaacccacaagatttaagccagctatctatcatctatcatctggttttaaactcctgacctcaagtgatccacccgcctcggccccccaaagtgctggaattaccagtgtgagccaccatgcctggcaaagtattttaaaaatatacatatttttagagtattttaaagtttttgtaagatgatctttattttaccacttgtttatgaagaactgatcatactaatttggtttcttttagttgctgtttcccatgtcaaggttagtaagatctggtatggatttaggttatatcaagaatgagtatatgcttcaaaataccagttccatcaagcttttcatcatttttccttttcaaattacctcccctagataaagatgaaaacccagttaacattaaaatactactttgttacattttcttttgatggagatattaagaaatgaagtatcacatcaaaagatttagtctctaaaaccagacattcattctaaaaaataagttacaatgaaataggcaaagtaagcctttatgcaagaaaggctttttatttatttatttttttacagtatcaaccacaattaaactatttctctgtgcccattttaaaaatcaatcattgaagcagataataattatatgccaaagaatttgagccctttaaatgtgtgataaagattaaatcaaattggtcaaagctattcttggaatgatctttttaatttgaatctgtatttgttgaagagcttcaagtatgaatgttcaatgaatatggctaaataaaaacagtatcttaactaaagtgattaattatgaaaaaagtagtgaaattcccttttaaataactgaaacctgaaaaactaaaaaccaattcaacaacaacaaccattacccaaataagtcttgaatactgatgcaagacgactcacgtgtcattgccacggctttcaactttttaccatattagcatgttaccattagtagaaacataaaatcaagacaaatcactcctttgacctctttcaaagagtttcagatccactctcgccttatggcataatattaaactttaataacatttctcaggtctgagaaggctaaaaagtcatgtgggtccagaaaagatctcactttgctgtgaatgggtaagatttagaaacctagtgttctaaaatgcatagttaagacactcttttatttaggcaattgtttaggtatttgttttaaatatatgacacatcaaatcaaatttccttgtctataattagaaaacggagatttttggcatatattttattcatttgaactaacgacttaaactaaacttacaaacatcttatccttcataataccagattacacaaatttaaagaacttgtatccaattggaagggcagctaatttttatgaggtgaaatctattttcctctaataattttgccactggctactgttttcataatagcatggcatgtaaagtaattctccaaacatgacagaatcataatttaaaggttgggaggcagttgaaaagtcatctgcctaatcaatcatcctgtctgatgcttaatcccctttataacccatttgctatctctggatatctagcttatttctaaaaacctctagtgaccatgaactatcttccaaggtggtcttttggagacggatggctctgggttcaatttattccggctctaccatttaccaactctttgatcataggaaagttggctactcttgaaagtttatcattattaaacgtgcaaaagcactaatacctgtttcatagagcccctgggctgaacaaatgtggtaatgctcacatagcctagccacagagtcgctgctcagtaagagttccttgcgtaactccaacagtatgaaattctgccttgcactgagctataatctgttgagttttagtctgactattggtctttttggggacacaaaaaacaaggctaatccatcagttacctttcaaacattagaaacctgctgccaggttccactgaccaggtctgtcaccttgttaaggccaagataagatagtgaaaacccattgttgacaggggcttagcaaagggcaatcaaaggaagacaaatgttcctggggccagtctgtggtgggtgctgcagagatgcaattctttacaaattcttgactggccaaaacagtgtataaaacctcctgggagctcttgtcactgaccgttgattcctacaaagtgtattttacattttaaaagccctgctttatcacaggtgctttaagccatactcacccttcctcgaatgaaatactaggatagagttgtctttgattctcctcacggggttggttaatacattatttatcctcattcccatgttaccagggcactaaagctcagaacaactgagtggttggttaattatccagtaaatgcctgatccaaaaccacgtcaaggtcttctggaacacagtctttcctatcatattcaattgccacagactgtaacaaatgtggatttgaaaacttttcgtaaagcaaaatttatgcagcactctgagaattctggattacttttcccactctaaaatcttgtctctgccagtgtcagtctcttgcttttattaggaaggccacaaagcattgtggtgaaaagaacagtctctggattcctgactctgctattcagtagtgggtcactttggtggatttacttaactgttccgaggctcagttttttcagctgtaaaaggaataataatagtatttaccttataaaactgttgtattaaataaaaggtacatgtaaaacagtataatatctcacattttctaagcactcaatgaatgttaattgttttactattcacagacaaagcttcagcccagagaactttctcaaacaaaattttttttgacttactagtcaccctatataaagctccttgaggcttaggattgtcttttgtctttagatagatagatagatagatagatagatagatagacagacagatagatagataatatagatagatagtatatatatatgtgtgtgtgtgtgtgtgtatatatatatatatatcctgaaaaactaaagaaaaagcatttggatctgtaaaataatttaataatctaggtaattaattctttcactcataattttgtgtgacaggtttacttaaagcaaaaagtaatttcatatacaaaagatgcatataatttcttccttacctaaacctttttcttaagaacctatacccaaaccacagacctcaggagaatggaacaacactgggaacctaactaatggaccaatcatttcctctcttgacatctggaattcagagggagacagaaagcttcattttggagtggacttcatgaggccacatttcagattagtgcctagaggagtcagtattctgagagaaaagattgaagtaagcacacagagagaagcagagatgagggaggcaaaacgaggagaggagaggagaggagagggaagggacagcagggaggtgctgaatgaatggctttccagcttcaggaggggcaaagtactccgatcaccaggttcctgaagagttcgctgcatgcctctaacaagtcctcctgtacctgagctttgttgaggggcttctgttccctgtaatcacaccacccctaagatactgcagtaacattatgtaagacaaactgcacattttaatccatggtcctgaagaactctgcaaacgctcttttttctcacttttcctatggtgcctttacctcacgtatggtcaaagagcaacatgtggctctgaatttcaaatggggaaagctaacagcacaaagaggtaaataagatgtccaaggtcatacttacagtttgtaggggcggaaccaacaacagaatttcatatttcttattccgaggggcctgcactaaccaataaaccaactgcctcccttgatgaaactaaagtatgccaattatccaaactgtgtaggaaacgttgaccaaaacaggggttaattggacattggttgttttaattccataatcagctccttccctgagctaccctgggagtgaataacatatctttcacaggaatgggaaggaagccagcataggccatctggctgaacatgtcctttcctcaagttatccctgcagctgtgtgaaacttaactgatgttgaagaactttacagtttaatttgctttatcatgttccctctattccattaaaattaaaagtagacaaatctttatgttcatattagccaagcagtttccctgactccaaagtcatggaatatacatgaacatatatagtctatgtgtgtgtggaggtgaggaggaggggagcctgaaatttttggatatcaagaaacacgtttcatattcaaaaagaacaattcatttagactagggccactagaaaataaacaaaaacttgtcattttcacatgaaaatgaaactaaaatactggtcttattaatcatgaaaaaaaaagaaacatgaaagagaataggtagcttatttccttgcccattttccccacttctcctactttgtaaatttgtaaatatgacaataaatctagactattaagtggaagagtatttcctaatgaatactctagaatcagatgtgcatccgtcaagtgggttcagtcacgattctagcgccactagcctaagagctgctccagaaggtgagcatgtactctttccctctcaacaattctctcttcctgcctccctccacccctcctcttacatggtttattttcttcttttctccatcttttatttctcaagtttgaatgtatttctacctgtcttactcatgaacattgctggcattcagatactgatataatgccaccatattccttatgctgggaactgtgtactagggagggccggggtgggttacttttaagcaatgcaaatactaatgcccaagtttgggtcagactagggctgtccaagccctagatgatgagccttgagcaaggttgaagagacttgagtaaggatgagaattaatgaggcagtgtagagggaatgtcttttcccaatacaaaatttaggtactatgactattaactagaagaaggtaagagccagagggcaacagtaagaaacagccaagaggtaatgaaatcttaaaagagatgctggtgttcaagctatatgtgtgaacagacatggaaaatgaattcctaaagtgaaactctaatgcaaagactgggtggatggttatgttgaagttggccagcaaacaaagaccagatggttctccctcagagggctagatggcaaaatattagataaagggaccctgatacagctaacttctatcatttctagcatcatatgcctgtatttataataataaatggacatagcatctaataataagtagccatcacactgcctgcaaagttcattagtgaagttgagtgggaagaagggttaccctaggtcaggtaaggccagttgtacctaagggctctacgtgcttctcgtttcatttgctgctgtcaactattaggttgccgcatgtctctacttcttcttaaataaactctgatggctcctggtcctagattacagccctggcccaaaatgtcttgacaacaattgcctaaaggaaggagtcaggaacaacaattattccatggtgtgatggctaagaaaaagaggcaaaagattccactgctgtagttctaactacttctcacttactttctttgtgcgtatcatgtaacatgcctcttcttattaacaggacctgggctctgtgggactgctctgaatctgtccatgcaaaccaacttttggaactctggggctacgagataaaggagaagaaaaaatgttctaggtgttattttctctttgtgcctcactctattcatttaaaaaaagaaagctcaacaagatcctctttgagattctactgcattttcctgggcttcagttattttacctccttattttaaaggcctttttgagaatgttgttagttcagctaaacatgatgactctgcctttcttcctctgctctatcttgtaggactgatgttcctttcaggcagaagcatgcatttccactcctgacagaataagatgccttatttcacctcccctattacccacaaaaagggagacttgtaagtgtcactccagaatttttgccattgagttttagagaatatcatggccataaaaaggaaataaaattatttgcataaataatgtcaaattttcaaaaagtaaatggaataaaatactcttgtatagaaaggaagaaataaaaggaagcaaggtcactgttccattcattttccccacaatattattaacacccaggcatatgataaagatttgtcaaaagacttcctaatattaaattggaagatgactaaaaatgttgtctatttacatctgagatagcaagaaacctcatccagaattaaaaagctgcgttcctttcatcttttttttccttttcccctttctctgaccaacattttctcctctattctaaatattgtacacagcccaaaggaagtcagtcttgttttgttttgtatgctttcagacaggtctcactctgttgcccaggcctgagtgtggtggtgtgaccatgactcactgcagcctgaaactcctgggctcaagcaatcctcccacctcagcctccggaatagacggggactatagttgcgtgccaccatgcttggctaattttacatgtttgtttgtttgtttatagagacggggtttcgaaatgttgcccaggttggtctagaactcccggactcaagtgatcccccgaccaggcctcccaaagtgctgggattatcggtgtgagccaccaacccctgcagagtctacatctgaaataaaccacagaagcaaggatatcacttaaacaatgtaacttaccaattcagtctgagtgagttttgtagtttataacatattgatgaaaacagttaagtgtccacattccgtttacataagagaatgctattcaagcttttaaaataaaaaacttaaactattcccctcaccccccaaaaagtctaactataaagatgggtttgctacaaaataattagcaaaactgatttaccaagtaagatgtcctcccgctcactgccccccagaaatacgtatactgtaggaatactcctaggaagtgacacaagtgaaagaaagaatattctttcaatatgctaaaaacatctacagtgcactaaaaaaaagtccctaaatttggcaatacatttcttccaaaaatgttattcaataacataaacattatgaagtagaactggctgtcccatatgttcagaataaaagggttaagtggagtcctgcataactagcaaagtggaagaataaatggtaagattaagacatacacatacaaacattaaaatctaaatatcagaacaactaaataaaaatttaccttgcatctctacttttaactatataataaaaaatggtcattggatagctgatacttgtcaaatctcagcaaacttatgagagagaagggataaaaatggttaaaccttaaaatacctgttcaataatcagtttttaattatcaaaaaaatgttgacatgaaaggcacttctacaattgcaaagggaaaccttgtattttgcatggctatgtagttatacctttgtgttatcagtggtgagtctggagataaaagatgatcacacataaccaactaaaatcgagaccagtaatgaccaaaaaaaaaaaaaaatcagggctgagaagcttcctatacttgacttcataaactattttactgtattggttactcagaggactagataccactccaatccacaaattgtcaacctcaacaatttaaatgtacgagtcagattttccacagttcacttctgaaagatcttcatttatacaaatatcccttctatattcatatctaaaagataccatgagccttaaaaacagtaacactgagggtcaaccatttgctctgtaaccccagcttaaatgtgtctgagcctcagtttaacatgtataacaatgtatttaatggagcagttatgaaaattaaagatgacaacgtcagcctgggcaacacagcgagaccccatctctaaaaaaataaaaataaaaaaatagctgggtgtggtggcacgtgcctgttgtcccagcttcttgggaggctgacacggaaggatcgcttgatcccaggaagttgaggctgcagtgaggtgagatcatgccactgtgctccagcctgggcaacagagagagatatgtctcaaaaaaaaaaatgacagtgtatatacaacgtccaatccaacacaggaggtcctcaagaaatgttaattcacctttttccttctttgtattacttactactttgaaaatgtttttatactcaagtatcttgaacaattttcggtataatactcataccaagtatctggtatttccaattcctgacagattctgacatctacagttggatcatgtatttatatattttactatgccttggtactttcaatcatatgacactgcttagtcacaataagcgtattgattcctctatcctattgtttataaaaccatccattaaaggcaaattgcaagatttttttgggggtggggtgggggcgcagactgagtcttgctctatcgcccaggctggagtgcagtggtacgatctcagctcactgcaacctccgcctcccgagttcaagtgattctcatgcctcagactcttgagtagctgggattacaggggtgcaccaccatgcctggctaatttttgtatttttagtagagacgaggtttcgccatgttggccaggctggtctcgaacgcctgacctcaagtgatccgcctacctcagcctcccagaatgctgggattacatgcaaattgcaagatttttatgctatacagagagttttcttgagtgctatctaacttttttattattttcatttgactagagaaaataaaactattagcttactgaaaaggatcagccttctgagtgatatgacatggatcaactttaatttcactcaagaaacaattttttaaaaatagaaattttcattggaatttcaaatgaactttgctttttacagtgaaaaacattgttgtcaactgcaaacgatatacaacaggcattttgtgaagacatttcatttcaaagataccttaaaaaagtagacagcacactgaagctaagagaaccagccttaaagtcaggtggccaggctttgaatcttaggttcaggcagtaacttttctgagattctagggataatattaactatttaacagggctgtaaaaaaaatgaaagcacttaacattgtgtctgctatcctctaagtactcaacaagttcaagtattctagagcaaacaaattttatttttccctctgaagtaaaagcaaaaacctacactcacctgccttgtattttatcagtactacaaaataaatccaaaaccttttgccatcactcagtagtataagtaacaataaaaacccaaagggtaataattattccaatttcatacacattaaatgatggtattgcaaatacagcttctgatccaaataaaacaaatggaaaatgtaactcacattcatgcagacagacaaccacatacatactaaataaaaggagtaactagataagcagaaatcacaagacatatgtcaaagatctgagttttagcctagagactgtcatttgcttaccagtattaaccttggcagcttgcatttaattaagtctcagtttcttcatttacaaaagagggagaaggagtcctactgcagagaatagttgggaagattacaggctggactgtatgaggaggtttcttaaacctgggatacaaggccttctgagaaatgcacatgtaggcctatgggatctgagattgtcagtagcttccaataaatcatcagttacttgaaccacaaaatattatgaaatgtaggtttgtcaaaacgcttcagaatctttaaagctataaatgattttaaagtcgtgttaaacttgcatgaattacagtgttctgggagagtgagagatttaattttgtaagaattttaatatttcataaatatgaaagaaagagaattcttatatatgtaaaactatagcctaggaaattctgtcaaataagactgagaaactcactggtgattagagagactatttttaatgtaaatttgtctgacaactgttgtgataactggtttagctgtgtgtgcgtgtgtgtgtgtgtgtgtgtgtattactgtactcacttcctaactggccctcctccaacacattttccacactacagccaatgctctttgtaaaaggtaaatctcttggctaaaaactcataatagtttctatttcacttaagaataaagtctgaattcctttctatggtttggaaggctctgcatcaactggctccagtgcatctgaccaaccttatctcgcatcatttagtcctttgctcattcattacgctccagccaggcgatgtccaacagaaatgtaatgggagccaccaatacaactttaaattttgtagtagccacactttttcaaagttgaaaaaaagtaaaattaatttgagtatattttatttaacaaaacataccatggtatcaatatgaaatcactataaaattcttaagatacttcacattctttttgtagtactaagtccttcctccaagttggtgtgtattttacacctacagactacctccattccggaaagctgcatgtggcttgtggctcgtagcttcttcattggacagtacagctctccagctacacagacttctctggatcccagaacaccaacagtgctctccggtctttgggcgtctgtgtgagtggttctctcttttgagaaagttctttctggctttcttatggctgcctcctttgcctccttccccaaactcagcttaaatatcacccgctaagatacgtctttcccaatgactttaggcaaacagtctccccattttattccctagcagagcacctcggagatcacagttgtcttaggacttctctcattctgtcattttttgtgcttgctttccttgcttttcaaatatttgtttatgtcctgttttccaccactagactataactattgctccatgagaacaaggaccacttttattctgttcaccatgggcacatctgagataccgaatttttgctaaatataataaatgcacgtcattactcttagttgctccctggccacttctaacataatattcagaaacaactgggagcataatatacgcacaagaaaacaataaataaatatatataattatttaaattataaaccaaataaagatgcttacatgatataatttttgaaaaatccttattttcaagacacttgtataaagataaataaatcactttattaaaaattataagtactatccagttaaaaaataaaacttcacttaaactcaaatcaaatcataaggcatttcggatatttctccctttcctgccttcctgagaaaagcactgtgttaactgctcttcattcggcattcagacttttaaagtcagatcaccccagtctcctacagatctacaaaaaatctctaaatgccaataaatttttacaattaaagggagaaaaaaggaaactatgagtgatatttgaagaaagataaaggtttagttaagatttaaacaaactaaattttaccttttctgctcttaactctcattttccaaatcatttattgtaattctaaactgagattcacagctccttcagacatattatacttttaagtggaaaggtgatcactgacaagtatgcagtttttgatacatattttaataaattcggtacaaataaaaatcacataactgatcatgacaaagaatatatactttgggagaggaaaaaatatgactaaagtgacagaccattatctaggttaaaaactgagaataaattaataggtaaaaaatagacataaatggttggatacagctcccatattatggttacctagtcaagtcgtctgttattaacagcaggataaaaaaatacgtcagtagaagacatggtaatcttacacgtagacacacaaacccacaaaaataatcattatatatatcatttatattatccttgaatatatatgaaaaaatatatttttatatttatatatatacacataaatatatttatatatacaatttatatataatttgtatatactccaggtattatacatttgtcttctcatttaatcctcataacctaaagaggaagacactaaaataatccccattttgcagatggggaaactgtggtgtaaagaggtgaaataatttgcttgcacactttgcccaactgttgaactaaagaaccaggcctggagatttattttccagtaattggaaggaaagggttagaaacactttaccaccatccctatgacttgtaagcttataaacttaattttgagcatgagacagccacgtctccaaaccacactgctactgtctagcagcttctccagtatctctgtgtttggtcaatttggctttctgatcatttctctagttccttgttcatttctctactggaaataaaaccaagtcatgagtagcccatgtggttgaaggcctgacccacctacagctaagtctgtcagcaccctgaactaggcatgtgaattttggatggaccttctcagtctttaacctgaatatttatctgacatgtaccgctgggacctatctgcaaaccacagctccaatcccaggagtctaatctctccatgaacaatctgaattagaatatttcttgaatttcttgaaaagtcagcatttaattatcactgaaggaggcaagcattgccccttggtggtccccacatggcaagagactcaattggctgccttcctctgcaaagccatgactatattattaaagaaaacactgccacagataccaaatgtcaacagactatataacgtgtttgtgatgtgctacagttgacccttgaacaacgctggcttgcaccgtgtgggtccacttataagcaaattttcttccatttctgccaatcctgagacagcaacaccaactccttagcctacttaatgtgaagatgatgaggataaaacctttattatgatctacttccacttagcaaagagtgaatatattttctcttccttatagttttcttcagacatctttcctctagctaactttatcataagaatacagtatataatacctataacatataaaatacatgtcaatcaactgttttaatgttattggtgaggcttctggtcaacagtaggctatcagtagttaagttttgagggagtcaaaagttatatgcaaatgttttaactgcacagtggctgggactcctaatccccacattgtccaagggtcaactgtattcacaagtttattccagtgtgaactctcgtagaaagagagagagagaggcaggctcgtgctctgttgtccaggctggagtgcagtaattcaatcacagctccccataaccttgaactcttgggctcaagcaatcctctcgcctcaacctcccaagtagctagttaattttttaatttttagtagcgatagggtcttactatggtgcccagactgatcttgaactcctgggctcaagcaatcctcctacctcggcctcccaaactgctgggcttacaggggtgaaccactatgcctggccactgtaattttatgtaaagttttcttctcaaattttaatacctttcttcataatactaaatatgttgtcacccattcttggcatggaagtctactgagtccacatccatagggagcaattgaaaattctgtgtgtatgagtttgctttgatttatgttctatttggttataaactttactgcagctacaggaataaaatttggctaatataaacgtaacaattattatttcagaagcataaaattgaacaaagagttgataccaggttaaaaaaaaaatcacttttttaaaagctagatgatttgtgttttagccctggctcaggtcctaagcagttttataacagtggctaagtaggaacttgcctaaagcccagtgttctcatcagttaaacgaactctttataataattcctaaggttcctactgctcaagaactccagtccaagcctagctaacactggataccaagtaacactgcatgctcatttactgaacttagggaagtatcacccacataaagttgttctcatgaatgtcttccatttcatggcttaaattaatagccataataacatgtcaaatgtttgttttctctatagtttaatgtacctagatatatctgactaaaattaactggtgattttcttggatgtttaaaataatttgttgatattggttaataagcataatgtacctaaactgacaagatgaaactctaagaattagatttcacagcttaacaaaattcaacaacacagtagatctgcatatgaggggaaagaatagaggcaatttgaagggaagaagaactcaaagcacacatttggaagaagtacactttaagactcagtcatttgaactactctgactggaaaacaattccataaacaccattcagagagattcctgtttcttcaatacctagagtactttcaaaagagcaactcatgtaaaaactcactaccatgaacactgcacagattgaaaccacaaatagccaagagagaagaaaggaatgtatcggggtgggtgagaggggaaggtggttgaggattccttattcatgtgttcaacaaatgtttattaagcagttattatatgccaggtacagtgttaagcactgtggatactttggtaaacaaaatatagtcctttcctgttaaaacaatcttccactccatcaaaaaataaataaataagaaaaaaaaaggaaaatatcaattttctctacttggtaacctattttaacttccccatcttacttggctaattattaaccatgtgcatgccatgtatttcttttgagaaagtgaaagattctaaaatcttcaaaatttgtaaagtaattacaaaatcaaaaactgtaagtaaaaagagtttaaagaacatgtttaattctgaaaaataaaatattctgatttttagttccatagtttacttttcctctacaatttctgatatgttttttcaatagagaaaaacccacaaaactaggtgtacaaaaatacagtacaaataattttgatgcctatatccaattgaaacaaaatttaatagtctgaattttgtaagggagttccaaagttctttgaaaacatcccctttatagacaatatgacctcaaatagttcattttaatcaatgtttttatgtcacagagtgatatatttattattaacaggtgcttaaaaatgcttcttcacttggtcattttctataaaagtatctgcaagccagtctagaccaatgtctatagcttgtgattatacagatctccggaatgtcttcaggatgtataattactacatacagaacacttattcacacatttaaatggaagtgaaatgtaatctaaaaaatgtaaagctatatactagtttcaagaatacaaaagtaaacaataggaaacaactttcatttcatcagtgtattagtatgaggtattttgcttcctctctctcctaaatcaagtgttctgattgtaatcgaaggatcaggatggggacagaagagggaaaagggcacctgcagttcacatgtggcaagaggcttggacaagaggaatttcttttctccccttgcagtacagatttatacacaaccgaaaaagtgcagctatgaccacattttaagaatgcctaaaaatgcccaggagtctaatccctatcacagatattttaatcactttataaaatcttaaagcatttattcctttcatattaagtaacctcaaataacccaaattgtacactacaagtctctatttgagtaacaatcacagaattaaaaaaaattataagaaatatgcaatttccttttctacaaccgaataaaacagtataatgtttatgcaaatcaagctagcagaagaataaagtaaacaacacatttcttaatttcttaatatagttcaaggtggtgtagtggccacctcttttctttttttcatgaaaatctctttcctttgcaccatgttatataggatctttaagaatataatgtactgaagataatttaaaataattttctaaactatgtccataaccacctccatgactgctcccatctgatggttaaaatcttacagtactagcttgaatttcatctctgcctcacatgtttcaagcagggaagcagatttagtgcctcagaacactttacagggtttcattatcaatcaggttatgttcccggtgacgctttcagtaaaattatcttattcaaatgaactctcttggactgaagtaaacaaagctgtagcccattgctctcacatactctccattcatttatttcctttttctttacttagacttacagcacgtgccctagaaagagcgcatgttgaatattcctggagtgtcacaatatgcaatacaataaaacagattacggccctacctttctctcacagcagtggtgccaagcacaggtacaccggagtaatcaatttgttctgcagaccgtaaggctttcatagaatactaatgtaaaatctcttttctttctcctttgccttgactccctaatgcccaggtcccgaccaatacaaggaggagggcggtatgtcttctgctgagataaccacaactactaatcaagtatacgtgtacaagggcacaggattaaacctccaccaagcttgagtcagggtttgagagcagctaaacacatgcacagcatggtcaaaattaaacacacacacacacacgcacccacgcacacacacgtgccatgaaaatacagatgtgtctacttcggtgaactaattcatcacactttaccatgcctcgtttttttaatctcaggggcataaaattacctcctgttgaactgaggacttagattcaacagtgcccaacaattgtttttccagaaacgagaatcatgatcagtcttctttgtactcaactgttaaccatttttaaaactaggcatttttcttaattgtactatccagcgcagttttacatgaatttatcatttcaggtattaacatagggttaatagactctgcatggattcttcagattttacacttaaaaatatattgtaatagctcaagtctactttaccaagaaaagtatgtgcattaccagtaataagacatacaaaagattttcatgtatcttgaagtatttacattatgaataatcccaagctatttgaaaaatattttcaggtctcaacaattatttaaaaagcacctttaacacttcataattatggcatcacggtggtatggttaatcttataaatctagagttctggtgttcttttcaattagacattttcacttggcttatttttcttttattcaaaatatgaaaaggtatgccagtcattgagtaggcgaatgacagaagttgttaaatattttttaacaacatacattgccacattttaatttgcctgccttaattttcaaataactcttgaaaagtattgatagttaaggggctgcaaactaggcaaaaattaagaacaaaatactcaaaataactgaagaaacttattaggaggcatcctaagccgttctgttttcatgtaaacaactgctttaacactgctaaaatacatgtgtctcattttgcactttttctatttcttaaaaaaaatcagtaggaacaattaagaaatactagggactcaatgaagtattgcaataatgtttaatcgatactgatgcatttgtccttgacacactgaccatgtcatcaggctactgtcatcttatatcatgtcatttctccacctggctcatgaccttgtcctctaaatgacctaaagcttccctcaagtagcaggaggcccctccccgctgtctcagcaaggtcgaacgggtcagcgtgtcctcatctataatccaccaccatttgtcagcagggaggctggaggaggcaggcttgctacaaggggagaatgcccaattaggcagctgtcacacaaagcataggctgcaaaattatcccctgtcaaaagaaagagcagctgcgggtgccaattacagcaacctttcaaccctttaggtactggaaactacacagaagtaaatgaagaacaattagtgataacaaatcgatgaattaggacagtaaattagaaattactagcaggtgagcttgggtcatacatgacatttagggcacaccagactccaggcaagggcaggatgcaatgaatcacactaaccatttcctcacatatagatttcccctccaatattttctttttgcaaacctgagatctttaaaatacccatacctaaaaatatgtatcttaatatacacaccttttcatttcatggacccccaaaattgtttctcaataggagaaaaatccttcagaataataagtctagttcattctaacttgttttcacacagtccaacatgttatcccctcaaacaaatttcttaagtgtcgcccacaaaatccaaaatatcagtttaaatcatcacacttaaaatattgtacttgtcctgattctacttcagtcaaaaagcaactgggtataaattctgagaaaactgctttgctaatatcataatgttgaaggtaactttctctacacaatgtcattttgtggataaaaaaataactgccatgtgtgcttctatacataatacacataaagaaaatatcaaccacaaaattactctcttagattgttctgctccaatcctgcagaggtgatatacattaagtctcaagcacagaaagccaatgcacttggactttgtccaactaatttatttggtagttaacattcgcaggcagtgaaggaggaacatggggaaacaagccccaccaaggggagcagatccaatatggctaccgagtgttcatggacatggtttcattgtgccttaaaatgtcatgcatgttcagaaacaactttcttaaagtccatttttaactaagattaattttttttccatagaaaaaagatggtcttcctacatcagttctttgaaagttgagaaacctgaatgatacgtgctgttatttctaaagaggcaggagaaaattgcttaactagacttctaaatcacaaatggataaaagtgaggaagagagaaggtgaggcaataaagaagcactttactcacccacctccaacacattataaataaatcacagttgccagagggaaaagtgtgtaactcctagttcctaagtccagccatgtgataatgtttctaggagatagatgtcatggggagaaaacttctccatgaaaagtttatctgagaatttgatttataaattatatttcatcatttaaaaactgggcatttataaattctcttaagtttagaatgcaaccctctaaagtcagacataaggaattcaaagcaatgacaaatagataggaatgaaggagttaatgcctttagaattcagcttccatcatacatgggtgactatctctttaaataatttaaatcctctccatcaactacaaagctgttttgaagccatttagctttgttctttacatgtgttctaattaagagatgaccttgtcatcacacacaccagaaatccgggattatttcctacagcaaaaattcacagagccccccaaagaagaaaaaggggggtaaaaaagtcttcttcctcagttcctcactaaaggaagttgttggttggttgaacgctgaggcagtttcaccgcataatttttttgttgttgttgaatgtcacagggcgggttagtgtgaccttgagctgcatcagcagcacagcaagggtcgagatgcctgcaggcgcccttgtactggatttgcaagacaaaaaccttcaaactggctgaaggacatcttaaatctcttcaaaggttttccgaactaatctgggctgctcttagcaggatctgtgccagtgtgagaagcaaaattaaaaacaaggtctttgacaggatgttgtctcctcttaacccttcccaagcagaatagaacaaaccaccagcattctggagagagggtttacctagaagcattcttttataacaaattatgtaagcagacaatcacaaagaatggggcagttattagttctcaaaagtaaacaacccttccattgtgcttattaaagaattcaggtcgaattctttcttgactatatttcagtgtagtgaatgtaaaacttaaagctctatttgtatctttcagatttgtagcacagtcacaggttaagactaaaaaatatttccatcaatatttatctctagaattttcatttttaaaaaaaaatacatggttttagttggttaagtcacaaacttcacgcatactgcatatagcttactaaaattacaggtaaggaaaattacattatagcatgtttactaaatttcttattcccaacatgatgaatacattcttaagacggaaaaaaaaaatcattagaatagtgagtaacacaagtaaaacaaggtaaagcaatctcggtcttgttataaaaacatcagcatgacatttgatgttttagcattaccagtgcatgggccaaaagagaaagtattaatgccagtagagggtgtttgattcttccctggcaatgctctcaaaatttaatttagtagctaaagtaggcaaatgtttaaatcattactctagaacaacaaaaggaaaaaggtgaataaaatagtcctggctttcaagaaataaatagtctggtggaacaaacagctgtaatgcttaaatcacaatatatgctaaaatcagtgtgtctccatctataacatgctggtttgtcatcatcagatataaggtatgtcatgattagttctaaagagtatttagtgtaagtatttagtgttaagtacagaatttaataaggtctaagaggttgcaaattattcccttttaaaaaaacagactaaataaattcaagataacttgggtgataaccacactttcactcacttggattcaggtatgttttcctgaacaggacaggaaaaggacagagtaataacacctagtgagtaaataagacccgagagtgcacagtgccggtgattttcttccttagtctctgtgccaaaggagagagagtatatactgtgctaaatgcaatgactgaaatatgtaaaaagtgctctaggaacacagataggctgtaaccaggtttttagttcatatgtacacatgcaggtggtagtcagtgatggttaaaaaatgagtaagggctagccaggcagaagagaatggcagccattctagggtccagaaatagcactcaaaggcaaggaagagctgagtgtgacacaggaagtgtggtagtccaatgggagtggagattaggctggaaatgcaactgggaccaaggactttgaatcaaggccatgccaagaagctggcctttatctggtgggtttccttacaagcaatggtattattaaaagcatattagaaaaacaaaaccagaagctatgggagttgttgatagcttggagggaagaagaaactgtagatcagttagtgcactgccatggtcaaaataaggcaaaggcaggagagttgaagaaaaagacagctctggaaacaatgaaggctgctttgaatatttaaaaaccaatttgtttaacataaacagtgctataagatagggtgttatttcatagcaactttattgaatcaaagataaaaacgataaaaataattactatatctcaagcctaggtttgataaacactgtgctaaaaaaatgatttctacaaagtttcaaaaaagtagtaattcttacaggggtgctttaaagaggcagaatcagatcctgtttgaagtctgaattttgtactttgaactatcaaccttcattaagtattaggtaagggttttgctaagacagtgacatgtaccttttcagaacagtgtgagagcgtatttcccttggctataagacagagatgtccgacttaaattataatgtggttcttggagctaagagttctatccaacgctaatgagaaaaaaaattaactcagcaaacatttcttgagtcccgactacgtttaggacacagaattaaaaaataaaaactacccaacattctatcagcttcatgtttttagatgatcactcataatgatatcaagtcctcaaattccagcttgcatgacatcatcacacaataaaaacactacgagtaaaaacagtatgaagctgtcagtaaatcaagtgtcggaactagcagccatcttggtattccgatccagctgaaaggtacacaacgcattcccagaaccctcagggaagacccagcaccaatgtaatttgaagagcgtcgtcagatactctagagactgactgtcccgctgagacctcagaaagaatttaacagagtatcagccaaggtaagagagtagggagtaaaacagaacaggagtcaccagggccaagtaaatatctgccagagagcagactgtactctcagaaaaggaccgccagcatcagggatcaggttgaggcaagtggaggggaaggtcacacaaaggagagaaggaaagacttgaggggaagcctactcaatcctgcaaaataacacatcaacttcattttgtgaaacttttttaaacgaccaaacctctagagttgggcgaatcaccgtagaagaagtattagaaggtacacaaatcataaagaggacttgaaagccggggtagggggaaaattgacagggcaaaactaggaatgaccttactgagtatccacaaataaaatgacttctccttgagtaagcatctctgtcttacagctgccaagccaacgctggcagtaagtttcagcacattctaggtctagacattaatagaaaagtgggtaatatgatacaccgtgcagttattaaaaaaaaacttattagtctacaaacacaaaagcaaggttaacattattggaataaaaatatagaagattctgttcgcaattagacaagtgaattgccataatacagcagtcctcaaagggtggtccaaggatgccaggggtggccatgacccattcaggaggcacatgaagaaaagactactttcatactactaaatgttatctggcttttggtatcattccttcataagtgtacagtagagttgtctagaggctatatacatggaatgcatccttgtgtaactcttgttttaaattttttctcagtttaaatttctaatatgataaacatcagttgatatgaatctcataaataaaagctctcttgggtccttgataatttaagaatataaagttgtcttgaaagcaaaaagtttgaaagctgctgctattaatagttgaaaagtacaatgttggttttcttcaaacataatctcttctaatttcaagaatttccactataattatggcagataaatattgttctctgtgcagaatgtccctaagaccaagacgaggaaagaaaagaaagaactttctaaaaagatgagtaaactaaggaggatatgaaaaatctcccatctctagagtcgttattattctgaatttaccatacaaggagtaacaaatgtacaaatatttataaagaagctgctatgttgttaagagctgaagttataaggataactaagtgataaaccagcccttagtgggctcacaatctcatcgggaaaaaacagatcaacaacatagtgagatgctactaaaaagatggcatggacaaagtggagaaagcactgaaagacacaatttttggaagaagactgagtggtaaggcagggaacaccatttttagtgaaggttctctacagaggctgcatgtgaactgactctagggacaaacaaggctttctcaattagaaaagaagcttcagtattcttcagaaagtaggaggaccataagcccagtccaggaagcacaatggcatagagtatgttctagaaactttaagtaatcacctccaagaataaaaattgccagtaatgacaaacttttatagaacatgacaaaataatttgatggcatgttctataaaagttataattaaatttaatgatgaaagatgtggacttagattttgtagtcttgctaaaaacttctgtcatatagctttttaaaaagacaataaaagtgagttactaaaaaaaataaaatagaaacagacaaacaaattattggcctttactgcagatattttgagaagcactagcttggaggacaggctagaagatggcaggtggggaggaggtgcagagaggggcggcaacagcaggagacaaagcttcaagctagaagcttacatagactgtactatgaacatttttttaaataaataaatgcaaaaaggaagcaagcgaggtttgaaaattactcatatacctctaatccagaatgaagaaattctagttatctaaataaaatgcataagctctgacgttagaatcagaaaattttcagatatgcaaaccacaggccacatggttgaagggcaaatgtagcagagaatcaaggagactatcaggttcacaacagttaatttcagtgaaaaaagaccagggtctgtgtaagaagagaaagtgtattgacagtttgatcaacacttttaaaattattttgattccttcatttgaaacctttcatggaaaaggaaaaaaaaaaaaacctgagttgatatggaggcttcgcatatagcgactttataaaatctgagttgatatggaggcttagtctagtagggatcttcctccccaaacaacgtaagttatatcaattaagatactaagtaaaagacttaaggaaaagtcaattatttaaagataccaaattaaaaaaatgttaattgtattaatgtttcccatagtaacagtaagttaggattaaggaaggtctattacttttctatgttcattatgctattgcaattgctacattatttttgatcagacaagtaacacaagcaagctggagttttaggaagatctggtggttgtaaaagactcgaacaaggatgtcagtaaacaggcctgccagcacaagagctccagatgagaaatgataagactctgaacgaagatggctggctgtgagaaagggaattaagagtggatggaagcaatgctggaaactaacaatgattcatttgagccaagcatacagattttcttaccagggttatccacaaggccaggaaaacactagtgagaaggccaaattggtttacggcaattaattccaactaggacaactcacccagattataaattgatctttctttcaccagcatcacgtttctactaaaaatctggtgtgaaagtttaaacacattttacaaagagttatttcttaaacaaataaaaaaaaatatgactttgaggagtgttttatgaagttggacaggcattccatgtatacaattagcctactttaccaacctcgtaacccagctcatcagtactggcactttttttttgagatggagtcttgctctgtcgcccaggctggagtgcagtggcgcgatctcagctcactgcaagctccacctcccgggttcacgccattctcctgcctcagcctcccgagtagctgggactacaggcgcccgccatggcgcccggctaattttttgtatttttagtacagacagggtttcaccgtgtcagccaggatggtctcgatctcctgacctcgtgatccgcccgcctcggcctctcaaagtgctgggattgcaagcgtgagccaccacgcccagagtactggcccttttttaaaaaaaaatttatatagatattttatgtctgacaggaaagttttaaactcaagacatctattctaccatagttgtcaaaaatttaatcaaactagaaaaaagtacaatagagaactcgtcctagtggaaaaccatgacatataacaataaaaattccattagagaaaattagtatattcaagtgtttaagctaaattgatttatggtcatttagttaacactaccgaaaatattctctgtttttgtatcagcaattttatcaaaattagctaataaatattatacactgagataaacagcacagaaagtatataaagtcctataaaatataaaaaagggtgaattaattttgttagttactcaatatgatgattgtatctctttcaaaagaaggagctaacaaaatagcaagggaaacatggcctaagacactgaaaggctttttaaacacttcattctttatttagtttgcaatattcaattaattacatcctttttcctcccaatcattatctttgagctttcagtcaaaaaaaattactatacttaaaaatataacatgagtgttttgcagggtaagacaaactatagtaaaaacctcataaaacattagtttagaatcctcaacttgtcaaatactcatctcctgagatataccagatcctccttttggagacacagtccactggttaatgaaaggcatattgaaaagacattctatactttgacccaacatctcccaagcttatttgaccatggactgttcatttaaaaggaaaacatatttaacacaacacgttttagaaaaaacacatttgacataatcatctttaaaatctaaaaacgtttaaaaatatgtgaaaggaatatagaaaatcactatcagtaatttgtttttataaatttttagttttcaaagttgttcactatacattataatgtctttttttttttttttttttttttttgagacggagtctttctctgtcacccaggctggagtgcagtggcacaatcttggctcactgcaaccccgactgccgacttaagtgattctcctgcctcagcctcccaaataactgggactacaggcacgcgctaccacacctggctaatatttgtatttttagtagagacagggtttcaccatactggtcaggctggtcttgaactcctgacctcatgatctgcccaccttggcctcccaaagtgctgggattacaggtgtgagacaccatgcctggctgtctttttttttaatctggaagaaaaatctaaatttgacaattttctaagaacaactcattggctgtgtatatttaccagatggctacctataatttacttatccaactcctagttggatccagtgagcattgcttatcattctggctatgtggtaaaacaaaggtgttgaaaattaagaacaacaacaaaccaattatatcttgtggcggggcggtcacaggaatatgcatgattataatgttaattttaatagaattagaagttcagaaatggggttcaatatcaactgtttcatcaaatataaaagcagatttcagactgccaaccagtgattaacacctaattatatctgaataaaaaaattttagtatttacaaataattgcgtcattgattttaaattccaattataagtaaaatataaatgaatatacgaaaagtgacttgcaaccaaataattattagtaattttatgcagtcttttaaaaaataacattttaaagattttcttgatgaaattacaagaaaagctaagcatttaagtgggtgattaaaataacttcattactaggttttctgaacattatcagaatagtgaagaaaaagcagttaggattatccatatgaggcctacaggtaaagagcaaatttggctcaaagttgccattccctttttgaaacactgtggtcaggtaaaacatggtgaatttcagcatgctgtatctgctctctctctttgaccagagtttttcagttagctagatgaaactgaactattcacaacggattatgagcacaataatcaatcattatgcctttacctagttcacttggatttctccttcccagaaataagcagcataaggtccaagagcttaagacatgacaaattcatttaggttgtagctatactagaaaacaggagtgttaatccaagtagaattaaccacttgctcatcgtcttttttgttgctctgcccacctacttgtgttaatttaatccaattactttatcatttctcagaaatactaataatgctctttcctttgtaagaggaattttaataattccaaaagtaatcactggcctatactataataaacacacaataatcaaacatgcttctatttttcctcaaaacggtaattaactttttatctgaaatcagggattgctattgtaggatttgtattaactgtccattttctctggtttttgataaatcgaattaagtgttgtcaacaaaaatactatttcttctttcaagctttccaattcctctctccagaagtaatctacacactgaattctcaagaatatttttctccatttctcttacagcatttaacctcttttactgtttgattacattatttatctacatttattctttccatataagttccttaaaggaaggattgtagctctttcattttttaaaccacattgcctgatgaagtaacttgcacagatgaagtacataatacatattttgaattataagctaatttataactgagaaagaattgtctgaaatatattaaagtcataatgattaagccttaagaactcaggaaaaaaatattctcaccgtctgtctccaagctctgagcctctgctttctgagaaagaaaattgagaaggctgttgaaaagtagctctgatgtcatccggagtcttcagattccctgtcctccttcagtcaagtgtgcatcttaacaagagggaaaagatagtttggcatctattccaaaccagattctggaataccttttgatcaagttcaacttatcccattaccttttcttgttcaagttcaatgcaaaagtagtcatttgacagaaaaatatcaattgtttatgaatgctggttcattaacagaaagcaatagatctctgctttctaggtaataatcgataaaagtagctgcttcaacaaaataagctgtgaaaaaggtttatagttgctaggatgtgtttattaacctttgttaatttcaaatttcttagcgtgctgtgctaaattaattaatttacatacaaaaaattataaatcctcctaaacgtgtatttcttaaaaaaaaaaaaaagaatagctatagttttcttatatggaactttttcagtttcaaaataccaagtatgtaatctttgcagcaaaaaaattggtaataaatatcaaatgccctatatatccatgaaaagatttacacaacaatgcccaaagtagatttatttttaatagtcaaaaactggaaacaactgaaatgcccatcaataggtgaatgaatcatatggtatatccatacaatataattttactactcagtatcaaaacagaatacacacaacacatacggaaaataaatatggatgaatctcaaaataattaccctgagtgcaagaagccagacaaaaagaaacatattttgtgtgattccatttggataacattccagaaaacgcaaattcatctattgtgaaagaaaatagatcagtgaggttgcctggggatgaaggatgcccaagggagggattacaaagaaatatcatcttaatggtgatgatggtttcacaggtgtacacacatgtcaaaacttgtcagattgttccttaaatatgtgcagtttattcatcaattatacctcgataaaactgtaacaaaaattaaatgccttaacatgttatatgtccgttgatgcagcaattccatgtctaagatttatcctaattaaaaaaatcatggaggataggtgtaaatatttagccataaggatgttcaaaatacatattattatatttgtgcagtacattgtatacagccataaaacgtcaaaatgaaaaaattagaaatagttaaataaactacagtatattacatcatggaatattatgtagtcattaaaatattatacaagaaaattaaattatatgaaattatatactatataagtgataaaaacaggaaacaacattatttcagcataattgaatttttgttttaaacaaaagtaaatgcagtaattatttctgcatttagaggtaattgttattttttctttttgctgatttgcattttctaatttctctacagtaaatacatacatattatttttctaacaaacaccacaaataaaatgatgcaaataggaaaaaatctaaaattttccactccctaatacaagtataaaactcctaagaggcagtgcacaatacagatgtagttctgagctatcacacggccaccagcagcaccctactaaatagctgtgggaaagagacaggtctgacacataaatgggagcatcattaagtgagtaatgctttaccagttacaaaatgctatcatggacatgactgtatttgattttcacaactcggtgaaatgagcagagattccatttcatagaggagcaacagatactgagcagggctggttaagtcatatgccccaaattatagatcttggactcaattaaatcttgactataaattcagataggaattctaagaagagtaggaaacaatcacttgccctgattatatatacctagaaggatgtgattcacacatcaacttaacaataaccatatgtgtaattacatgagtactcctattagaatgtggtagggacctcgggaatttctgaagtctccaatccccagtctctgaagtaatactcaaggcacgcccatcttcccgttatcaacattatctaccaactcactgaaattccagtagaatttaactgttcagttttcaattaccttttttccttcttgaaaaaagattataaccttttattttaaagttggaacaagaaagtacccataactatatttgagaatgctggccgggcgcagtggctcacacctgtaatcccagcactttgggaagccgaaatgggcagatcatgaggtctggagatcgagaccatcctggctaacaaggtaaaaccccatttctactaaaaatataaaaaaattagctgggtgtggtggtgggcacctgtagtcccagctactcgggaggctgaggcaggagaatggtgtgaacctgggaggcagagcttgcagtgagccaagatcgcgccactgcactccagcctgggcgacagagcgagactccgtcaaagaaagaaagaaggaaagaaggaaggaaagaaagagagagagagagaaagaaagaaagaaaagaagaaagacaagaaagaaagaaagaaaagagaaagaaagaaaagaaagaaaaagaaaagaatgaaggaaggaaggaaggaaggaaagagaatgctgcaactagtaatctataaattgattactggaactttaaaatgtgaacttgtgggctaaatctttttttggtctgtgtatatagataagaaaccctacaaactggcatattctataaagaaaaccaccaactcctgagaagggtaaaaggaaatatctctagaggaacattactattatcattattatttttatttttagagacgaggatctcgctatgttgctcaggctggtctcaaactcctgggttcaaatgatcctcccgactcaacctcccaagtagctggaactgcaggtgtgcaccacggtgcccaacttagaggaacattattaatgaactggtcattatctgttgatgacaccatgaggaatccttacagctactactcttaccaacactcctagaactaagagacttaacaggtaatgataactatagtttaatgagcaattactatgtctcaaacataacaataagccttttacagatataatcttaaaaaaaccctgtaaggtgattattattatccccagtttgtagatgaggaaactgggtttaagttaccccaaatcacaaagtcaataagagactgaggtggaattcaaatcccagtattttggaaaaagacagggccttgacagttctctggaaaataaattctgatttttccctactactgttcatctacaatggtctcaattcaggtaatgcaaaatacttggtactagcatatgaacttaatgagcctacattttccatgtaaaaagttaaaagtattccgagcccacaatgtgtatttgatattttgtcacattctagaattgtttatgttaatggttggtctctactaagacactctccttctgagacaaatatatgaccacacaaaagataaattaaaagaatatttaaataaaaccaacaaaagataacacaaaataaactactctaacattaatacttaaagttttcctatattaataagtgagtaaattagccttcagttcaagtcagtgaaactgaatatgccagatgtgttctgaatcatgacaaaagaagcatgtctaatgaataagaaaattttaaataacttcatcataattatattatgaaatattatacaatctttaaaatggatgttttcaaagatccatttatttaataatgtggtaaaattatcacaatacaatgctaagaaagcaagatactattcatctgagttgaacaaattgctaaacaaattagaaggctagacactatgctaggtgttggaattacaacatgaataagacgaacacagttcccatgggaaagagacaggaaagaagcaaacagaaaataaaataattgaagatttcaaacaaagcaagaggtagagaggaagctattttacataaagtgataaggaaaagcaaaagcttctctgagaaaatgacatttaagctgagaaggccctagtcatacaaagaataaagtgaagagaatttccaataaaagaaatagtgtatgcaaaggacgtgcctgcttaaggaactgagagatgaccaaagtaggtagtaatgagcaaggaaaaaaatggtaacaaattaggtcagagatgtgagcataaaggatgatctcaaatttgttttttaatgtgttaccccacacacatatacacacaccatactgaagggacggagaacacaatgataacagtgatattctagatggtaggaaaaggagtt

SEQ ID NO: 147 - DNA, 4649 bp, Homo sapiens
  source 1..4649: mol_type = genomic DNA
tctatctttacatagatttaagcagtccagaatcaactacagatgaaccacatggatccaaggtcccttcatggttccctccttgtgcctgaatgcagaatggaatttggggtggctgatacagcaagggccacagtggcctggcgctaccagttagaagctagaaccttacaagcactctgtagtacgttggaacccagctgccttgaaaatcggtgaaaatcagtacctattatttttcccagctacacctaaaaggcctgtgaagtctgcttttcccctggaaactgcagcagtggcatcttgaggccacctgccctgccaagcacctgtgggcgctgggcctttccctgtgaaactgctatgttgctgttgatggagaggggcccaccggcggctgctgcccacatttaatttattccatgttgcacccactttctagggcctcttgcagtccgtgagaggtgtggagggaatttctgccagttgggtttaagatcatgggtagtacattccagaaagtgggtgttgactgacaggcatcagggggaagctaatgtaaggattttccccattgactttccttgcctcagttaccactgagtaccttccacagcctttgggtgcaccaggtaccgtgttctaagaatataatttttcttggacagctgctgtcttggctggggattggcttgatttcaaaacaggtggtgcaaatgctgtgataatcttgtgagtgtctcattaatgctgagccacttagactcttggcattgagccagttaaactcctgagtccctgaaggaattgcactatgagaggcgctccatatctcttctgaagtccttgcgcctttcacttaagatgcccctccccaccagcctctccaaaggcctaaggagaccagttagggctccacagaaagtcattctctgaggaaaaacaccacaagccacaacgatcctctagattcaatatgctcacagcctgctttaaaacctcttacccagaccaacgtcactcctgtaaaaacccacttggcctaatacaaacctccacatacaatcgaaggtaaaatgtcacggcctctactgcaccccgtggttcacaagactcccaatcacatgcgtctcttactacccaaactctgctcttctggttttgatttttcaatgtctgtatacaatgccgccctgccaaatgttgggtttccaaaggaacattgcatattcctttcctgagctatgaagaatttgagagagaaaataaaggaatggtagatgggaaaccaaaacaaaacctcagttgctgataatggagtagcttagcgtgagagcctagtgcaaactccagaatgagtcaagttgaccttatcaggttgtttcttgttagagggaagtaacttttccacccttggtttccatgaagggagattttcctctgggcagcatagcaccacctatactccgctaatcagcatggtggtgtggaggcgtagagtgctagtggtgctatttggagacgggcacatcccaagaggaagaatggccatgcagggcagaggacaaccagttattttcagatttatcaatcagccagcgcactccatctctgcagggatgaggggagcaaagaggttgagggaagatcatgttccaaggtcagagtgtagaaggtgaagggaagaatgtggaaaggaattacgtggaggcagagtctgggggctttgagaagcttgcaagaagagaaagagaaagataccccagaagaggagcagactcccatgaaagccacgaacttgccctctcatctgcacactccactactagcgggaacataggttcaggtttaaaagccaagcctgaccttgtgtttaactgcaaacacttctttttcctcttcctcatcttattcttaaagtataaatgcaaagatcatggaaaatatttaaaaattgagcacattaccttttcattttaaaacagccatcctttaaaacagacaccattttcattctgcactcttagtttatacttaatcactgtcccgaaagtcagctgttttctaaacagttaatttccttctttcaggagaccggacctaaataattttccagataccatcttgatatgcaggtttcccatgtgatgtgaatctcttggcaggagatcctgttaacaatacccagcacgctatatgaaaatatccactataacttaagctttctaaagtaatacctatttggtccacctcagaaactgacagtagttctgttttgagctattaatttcagagaatcttcctttgtgaaataagcatgcttatgttttccttgctttgatttaaatgatagccttaactgctgggcacaggactactattaaaaccttaagaataagattttctgaagaaggaactcgttttttaagcactgtgttttcatctcatttgagcgtttactctgggctttagaagacctcatctattatgctcaacatctgatatttgaggggttctgtttcagggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggtaggagaatttggctagtaaaagcacttaatggcctgaacttgtgtttactagggcctgggagagcagacagctgccagcatacttaaaataggttgagtatgaagtatgcacttaaggactaaaagaattgcagaaatttaagcaatgactcagttacaaatccaagccccttcagaaagtacaggaactatggggaggaatagaaagaacataaacctgcagtgagacagacctagttttctttttttttttttttgagatggagtctcacttttttgcccaggctggagtgcagtggcgcgatcagagctcacagcaacctctgcctcctgggttcaagccattcttctgcctcagcctcccaagtagctaggattataggtgtgcaccaccacacctggctaatttttctatttttggtagagacggggtttcacgtgttggccaggctggtcttgaactcctgacctcaagtgatccgcccgcctcggcctcccaaagtgctgggattgcaggcgtgagccactgctcccggcctagacctagttttgaagcctggttttgatgcttagccacagtatagccaaaggaaaattacttaatgtctctcagatagaatttccttatatgtatgtctttcatgttgggacttctggtcctcgatagcaaagtaagactgactcaaacttctactcacacctcgtgaaaattcaaatcaattcaccgcattgaatgccttctttaatttgctctgttgcccaggctggagtctcagctcattgcaacctttgcctgccaggttcaagtgattctcctgcctcagcttcccaagtaactgggactacaggtgcgtgccaccacacttggctaatatttgtttttgttgttgttgttgtttttgttttttttttttgagatggagtcttgctctgttgcccaggctagaatgcagtggcatgatctcagctcactgcaacctccaccttccaggttcaagcaattctcctgtctcagcctcccaagtagctgggactacaggtgctcgccaccacacctggctaatttttgtattttttagtagagatggggtttcaccgtgttggccaggccagtcttgaactcctgacctcaggtgatccacccacctcagcctcccaaagtgctgagattacaggcatgagccactgtgtccagcctaatttttgtatttttagtagagatggggtttcactatgtttgccaggctggtcttgaactcctgacctcatgatctgcctgccttggcctcccaaagtgttggaattacaggcaagagccaccgtgcctggccggttacagttttctaagaaatggcaatggaaggcctcactgagaagatgtaagaactgaaggaggtgaagtgagttttagtggttacacattgcaaattatttttggctaagttgtaagtaaaaaatagaggaaataaccaatcttgtatggttgtagtaagaatcaaatgaaacaatgtatggaagagtgtctaccagaaggccccatgacacagctagcacgcaataagctttcatcgtcttgtatagaatggtaccatccaattcagtacccactagccacatgccacgtgtcacaacccccttcttttcttagtacctttttgtcagaggtcccctctctgttcctccaacttgccaaaattcacctccatctcctttgcagcatttgagaaggaactggccaagaagtgtttttggaattcttagctgaccacccacctccagcctacagaggtggttgaaaagactaagaagagttttttggagaagatagagaattttgttagaaaatgtggtagtgctgggactgtaaccttcttaatcttagtgaggggggctatgagatgcccactaaaaaagccttgacatgagtcacctagagtttggga

SEQ ID NO: 148 - DNA, 32126 bp, Homo sapiens
  source 1..32126: mol_type = genomic DNA
aaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctgtttccatattcaatagcccttactttctatgcacgcaggacgctatttttcttcacaatcacccgtttcacttgtcgatacattgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccatgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacaagggccctgctcacggtgctgctgcggaggcagcctcctcccgcagggcagggatgttggtgtcagcctcgttccttctgcgcaggcgcagcattattcatgggctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccgatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagccccagggaggtccacactcgaaccctgtggctatggggccctatgtggcaaaagggactgggagggtggggttaagtggaggatcctgaggtgggaaattatctggggttatctgcatgggcccgacatcatcatgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataa

SEQ ID NO: 149 - DNA, 6952 bp, Homo sapiens
  source 1..6952: mol_type = genomic DNA
aaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaa

SEQ ID NO: 150 - DNA, 36776 bp, Homo sapiens
  source 1..36776: mol_type = genomic DNA
aaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctgtttccatattcaatagcccttactttctatgcacgcaggacgctatttttcttcacaatcacccgtttcacttgtcgatacattgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccatgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacaagggccctgctcacggtgctgctgcggaggcagcctcctcccgcagggcagggatgttggtgtcagcctcgttccttctgcgcaggcgcagcattattcatgggctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccgatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagccccagggaggtccacactcgaaccctgtggctatggggccctatgtggcaaaagggactgggagggtggggttaagtggaggatcctgaggtgggaaattatctggggttatctgcatgggcccgacatcatcatgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaagcaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaataactcccagaaaaacagcactgctccacaacccccacaaaatacgacagacaccaaacatccttagaacagcagcactgctccacgacccccacaaaataagacaaaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgaggagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctcccagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcagg

SEQ ID NO: 151 - DNA, 32053 bp, Homo sapiens
  source 1..32053: mol_type = genomic DNA
ttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctgtttccatattcaatagcccttactttctatgcacgcaggacgctatttttcttcacaatcacccgtttcacttgtcgatacattgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccatgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacaagggccctgctcacggtgctgctgcggaggcagcctcctcccgcagggcagggatgttggtgtcagcctcgttccttctgcgcaggcgcagcattattcatgggctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccgatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagccccagggaggtccacactcgaaccctgtggctatggggccctatgtggcaaaagggactgggagggtggggttaagtggaggatcctgaggtgggaaattatctggggttatctgcatgggcccgacatcatcatgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaagcaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaataactcccagaaaaacagcactgctccacaacccccacaaaatacgacagacaccaaacatccttagaacagcagcactgctccacgacccccacaaaataagacaaaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgaggagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgaga

SEQ ID NO: 152 - DNA, 19829 bp, Homo sapiens
  source 1..19829: mol_type = genomic DNA
ttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctg

SEQ ID NO: 153 - DNA, 13399 bp, Homo sapiens
  source 1..13399: mol_type = genomic DNA
atggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctg

SEQ ID NO: 154 - DNA, 20996 bp, Homo sapiens
  source 1..20996: mol_type = genomic DNA
cttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaagcaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaataactcccagaaaaacagcactgctccacaacccccacaaaatacgacagacaccaaacatccttagaacagcagcactgctccacgacccccacaaaataagacaaaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgaggagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctcccagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcaggtttcctctctgggcaaaggaagcatttttctcataaaacaaaatcaaaaaaagcacgtgagccaccgaaaggaagaaaacatcaactcactgcatctccgtagcccccaggactgggcttgggggcgtgggacttgccccctggcctcgggcaggccctgccccatggtccctgccgtaatctggggacgtggatttgtctgtgtacgtggggatggctgtgctgggagaggacgatgcctcagaggatgggcaggggctgtgcggcagggaggggacacggagatgggcactggcaggcttacctggccgggaaggtggcctcgcctggcatcctgttccccacaggatcggcgctgcacccatcacacaggtgaggaaacccaaaataaaggtgtcaagtgtcctgtgagcacctacaagtgccctggaaggaaggagcctgggagtcttggaccctgccatgaggaggaggtggaggaggggccaccagaacctgggactggggggttgccgggatgtggggcatgaaccatggagcagaggaaccaaagggtctgaaggacggggggactgcgtggcaggcctttgcagaatgctctggaacagggtgtgggctcctctgcctggagccggaggttgagtaaggaggtggtaggaggcgatggggcctgagagcagaggtcctggccaggtggctgcagctgcaggcggcccgctctggtgttgggggtatgtgggacgggcaagggcgggtgtttagggaggtgcatccggtggctatgggaagctgacgaggagagcagcaggtgcctggcatgggcaacaaggcgtgagcacctgctctcacgggtggctgccacacaggcaggtgtgtcaggacttggcaggacgtggtgtccatgcgggctttagtagtgcagaagagcactttctgtatgcaccatgcttctgttgtggacttgcgaatcatattttcattatatttccttaggtgtgttctctttctatgaaattataaagacacaccttcctatattcatttgatacattttaaaattagtttttttcactgagactttaatacagctgaaggctgattgtataaggtgtgaggaggggcctgatttattttgtgaattcacagagaaagtgagctgcctgacttcatttcctgctaagatctggcccctcccctgaggtgtggctcctccctgaggtgtggctcctccccttaggtgtggctcctccccttaggtgtggctcctccccttaggtctggcccctcccctgacgtgtggctcctccctgaggtgtggctcctcccctgaggtgtggctcctccctgaggtgtggctcctccctgaggtgtgactcctccccttaggtgtggctcctccctgaggtgtgactcctccccttaggtgtggctcctccccttaggtctggcccctcccctgaggtgtggctcctccctgaggtgtggctcctccccttaggtctggctcctccctgaggtgtggctcctcccctgagatgtggctcctccctgaggtgtggctcctccccttaggtgtggctcttccctgaggtgtggctcctccctgaggtgtggctccttccctgaggtctggctcctccctgaggtgtggctcctccccttacgtctggctcctcccctgaggtgtggctcctctttcaaagctctgtatgcctctgtcccagtcatctcatagcagatcatgccactatttgccacagcgttgcagtaatcctgactctgggatagcatgtctttaaacctgccttttctagtcttgagcctttagcttttttgtgagtttaaaagccagtttttctagctccatgacaaatccattgataagaattgtattaaatttatagaaaaatttgagacaatggacacttttatgataatgagtcttctatgactgtatttgtcaacatttatttatgtcttctctttgtccttccctaaagttttataattttgttcataaagatcttacatttttaaataatatttattcctcaggtatttgataacttttgttatttggggtaattataacatttttttctttttcttttttttttttttttttttttttttgagatggaatttcacttttgttgcccaggctggagtgcaatggggtgatcttggctcactacaacctctgcctcctgggttcaagcaattctcctgcctcagcctcctgagtagttggaattacaggcatccaccaccatgcccagctaattttgtatttttagtagagatggggtttcaccatgttggccaggctggtcttgaattcctgacctcaggtgatccactcgcctcagcctcccagagtgctgggattacagacatgagccaccatgcctggtgtataacatttttttatattttcaatttttaaaaatatatataggggcattattaattttgtttgctgactttgtatctaacaactttattaaaccttctcgttaattatataaatgtgtttgtagattttctatgtaaataatatatattctgcaaataacaatattgtctttctccttacaataatcatgcctcattcctttttcttgccttattgtgctgggtaaattcttcagtgtaatttagaatattggtaatattaacaggcttccttgtttctgacttaatggaaatgctatcaacatttcaccattaagtatggtatttactgaagaaatttataaataccttttattggattaggaatgtttctatctagtcccaatttgtcaggggctgaatgctactaaatggtttttctgccattgattgagatagttataagatgtttcccctttagccaattagtgtgtgaattatttttatagctcctttagtgttgagccatccttgcattcctggaataaactcttctgttatatttaacgtactgctggagttaatttactaacattttacttaagattttaaaaaatctgtgttcaaaagtggaatttgcctataatttatatttcttgtactgtcttactttggttttggtatgaggttataccagtctcaatgaatgagctggtcagctttccttcttttctcttctttacaaagaagagaatgtttgtatgaggtggagataattatttgtttcttaaagtctgataatacttagctatataactgttagctctaacatattttgagcaagtggatttctttttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggccgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaataatataaatatatagtaatttctcttttgagcattgatatttattatgtatttctcttctttttttttttgattattcttgccagtggcttaattttataatcttttcaaaaaactaacttttggatttgttgattatcttaatttttcgatctcatccatttttgcttttattgttatctttccttcctttctacttcttatggatttgctcttgatttgtgtgttagagctcatttttattcaactttcctggttttctaataagggtacctaagactgtaaattctctctaagacctggtaggctgtaacccttaaattttgatgtgtagggattttattttttactttatgaatttcattataatcttcattttacacttttgttttgctcttttttttttttctttttgtggagaatgaggtcttgctctattgcccaggcagatcttaagctcctgggctcaagctatcctcctgcctctgcctcctcaagtgctgggattacagatgtgagccaccacgcccagcatagtcttcatttgattgtttagtgatgtacttttagctttttttatcttgagatggagtcttgctctgtaccccaggatggagtgcagtggtgcgatcttggctcactgcaacctccgcctactgggtcccagttcaagcaattctcctacctcagcctcccaagtcactggaattacaggcacgcaccaccatgccagctaattccttttgtatttttagtagagatggggtttcaccatgatggtcagcctggtcttgaactcctgacctcgtgatccgcccgccttggcctcccaatgtgctaggattacgggcgtgagccactatgcctggtcatgtgcttatagtttttaagccattctttgttatcaccttctagttttattgcatttttgttggagcgggattggcaacacgctgattcttgaaattgaaatgtcctccgtggcccgtctctaccctgggttgttgcagctgtttggctgtaaccctaaactaacacctaacccctaaccttaaccctaaccctaatcctaacccctaaccttaaccctaaccctcttggcccattcacaacagcagcctgtgtgagcttgtctgactcaagtcattcacacactcagatgccctttctggtataggagtgactgtccccacgtctgtctggggccagccccctcactgtattagttttctatggctgttgtaactaagtaccacaaactggggggcttaacagaaatggattatctcacagttctgagggccaggagtctgaaatcaaggaccacactccctctgagggcttgaggggagacctcttcctgcctctccagctcctggtgttcctggcagcccttcgtgttccttggcttgtgatctctgcctccctagccacatggcctctccctgcacgtgtctgtgtctcttctgttcttaggattataaatcgtactgggtttagggccaaccctattccagtgtagcttcatcttaactaattacacctgcagacactatttctgaacaaggccagattctgaggttctgggaaggacatacatttgtgggcattgttcaccccagtgcatctttgtgctagacccatctcccattgcctttcaaggacctcatcccgggaatgtcctgctcctcctgcacccgggtcctcctgccctcttgcattgctcctgccaacataaactaaacaagcccctgcccgcaagtcccttcctctttcgaatccactccacttgggctttgcttgccccctctttctgagatggattgaggtcaggtcagcaaagattctgccttgttcaacccataggccagctctccacccctcaacccacctgcatttctggagctgagtggatgagtgaatgaacgtgtgattgctgtagccagactgtcgctgtttttgcgctttggggttgtgtgcgtaggtttatggacgggcctatgccttgatgtcgtgatggaactaccgggcacgtggcagggagatgaggggttgagaaccatatggacgagatcatgaccgggggatcagagatcagggcacagtgagagcagctgaagactcaggtgtggggtgggggctgcggtgggaggagggcagcatggtggtccgaagcccctgctgcccggcccgctcaggctgactgagaagcaagggtgcagagtgtttgtttccctcctggcagaagcgagcgtgcatgtggtaggagctggcaggcccctaacctccctcctggctctgccactggccgactagggatggggacagtgagatgacagcagggccctggggcccagagcttcctgtgggggtggactcatgccaggcagagcgtgtggcctcctctgtgagcttcttgaccaatgcactgcactcagcacgaacagcagttacagggagacgaggcagccttgctcccagcagcacgacctctgccttcctctccttctggagctcagtgcagctctgcccagtgccgaatttgtccgtggccttggttctgggttctgcccgctcagtggcgtgagtgcaggaaggagaatggtggctggcaagggcggggtggacgggagtgagagacgggcttggggttgaggggaggcagcagtgaccctcgcaggaaccctgactgagccccggccttcgagctgaggtccccaagccttgctgcatgtgttgccagctctgtagctgggtggggccggggctctggtttctgagcagcttctggggaggctgcctgggccccaccgtgcaaggccccccggccacagaggagaccgcagagtgagctgggagggctgtctgagaggcctggccaggtgggccctacacactgggcatgttctggtgcggactctgatcgctgtgggctcgggcaggtctgcgcagaggtgtgacgagagctgggacccctgacagctgggcgggaacagggtggctgctgaggggtaacagagaggaggggctgggtggaggcagggaggccagctggaggctgccccgccaggcagggtcagggacggtagcgcaggcctggctggtggccgccggtgctagaggtggtcagctgtcctggggcagccacggtcagctgtcctggagcagccacgcactgccgcgcagactcaggaggatggagtctaggctgtggggagaggaggccatgaggggtgggtcagaggctgcagctctgatggggtctggaggtcagagtggaatggtggaggaacgataccactgtccccactgtggcatggatggtggtggggactgtggtggggacggtggcggggacgctggcggggactgtggcagagacgctggcagggatggtgacggagactgtggcgaggactgtggcagggacgctggcagggatggtgacggggactgtggcggggacactggtgttgggaacgctggtggcggggatggtggcggggacggtggcagggatgctgtcggggactatggcggggatgctgctggggaccttctgtagacgtggatgccgcccccaccgcacgatagcggcagtgcatttcttccttctgttttagtggtacattcacaggaaatcgcccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccgagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctactggggggatgcgggaggcgtctgtggataaacgtgaatatgcccgaaatggggcaggaatgtccatgctgcccatcctggaggaagatcccaggacccatcccctctcccggggctgccttcactttcctgccggtccctgcccattagagggcaccctccacggggacacagccccacactcacccctaagtctcactcctccattcccatccacggggacacagccccacactgacccctcagactcactctccacacccatccacggggacacagtcccacactcacccctcagacccactctccacacccatccacggggacagagccccacactcacccctcagactcactttccacacccatccacggggacacagccccacactcacccctcagactcactctccacacccatccatggggacacagccccacactcacccctcagactcactctccacacccatccacggggacacagccccacactcacccctcagactcactctccactcctatccacggggacacagccccacactctctcctcagactcactcctccccacccatccacagggacacagccccacactcacccctcagactcactctctactcccatccacagggacacagccccacactcaccccctcagaccctctccatactcatccagagggacacagccccacactcaacccccaccacaggctcattcctccacacccattcacacacagggacacagctccacactcaccccctcaggctcactcctctgcactccagcagctggcccactgctctcacccaaggcacgggccgccttctgtgcaggtgcagacgcctgcgtccctgaggaagctgccgggggctcttgctgcccccattgggcaggaatgggattctggggcccaggcccagctgctgtgccctgtgctctctggggcctctgcctccacagctgggacctccccccagcggaggggcctttggcctcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgggctgcactctgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcc

SEQ ID NO: 155 - DNA, 5926 bp, Homo sapiens
  source 1..5926: mol_type = genomic DNA
acagaatcttcaaaggttgagatgaaactcccatcatacttactagcaataacctctagcaaagttgaggtggtctgttttggctaaataaaatggacatagcattgctgggcccctgtgaagggctggaagcagggaaatgtcagcagtggcaagcgtgccctctggggagtagggaatttccctggcgctggcaggcagcccatgctgccgtagatgtttcctgctgtcctgggtggcctcacacagagcagctccacacctgctctttgaagttttcttggggtgcctgctggctacaaggggtctagatgtttatgacactgatataaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcgttgctgcttcgttgttttgttttgttttgttttgttttgttttgtttttttagatggagtctggcactgtcacccaggctggagagcagtggcatgatcttggctcaccaaaacctctacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacagttaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttaatgcaattgtatcttgagcaggcttgttaaatcccgtgggaggctttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccaatgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttaccaagataccatttcttacagatgtgcaaataatcaaaagtctcacttgatagctatttctaataatgttgctatttctcatgtacgtgcttaattggaaatggtgtattaaataaaggtgaagaggcagttgccttttcagcttaaaagagcattaaagtttatgattgttaacttctaaatttattctcagtgtgctttgaaatagactttataacaaaagcagcactaactctccctagatttcctaggaagcaggtaccaaattcttatgcacctgcatgcacaggctgccaggatgcccccgctctactgtggattattctaggctgtttctccttccttccaaccaccacacccacatccctaaacctaggggtttaaatttaggtaacacacctagggcttgttaaatttaggtagtttccacacttcgaccttttttcttaggatggctctgtattcattatggatttcataagtcacatggctggaaggtacctgatattcttaggatggctctgtattcattatggatttcataagtcacatggctggaaggtacctgatacagattaaacacagaatttagttaggatagcattctgtctttgaaggctgtgtgattgcagcccaggccaagccaggcagaagttgggtcacttgagcagggccctgcaaacacacctgaaggaggtggcattgctaggactctacttttggggctgaatcagcagaggcaaaaggactgagtaagtccttgctgaggatggcacagctctcagctacagagctaggaccagaccaggctctggggttcatgcgggaatcaccagtctgcgctgctgcctcctcctgtatgcgtgtgtgtgtgcgcgcgtgtgcgtatatgtgtgtgcgcgcgtgtgcgtatatgtgtgtgcacgtgtgtttgcgcgcgtgtgtgcgcgcttgtgtgtatatgtgtgtgcgcgcgtgtgcgtatgtgtgtgcactgcgcgcgtgtgcgcgcttgtgcatatatgtgtgtgcacgtgtgtgcgcgcgtgtgcgtatatgtgtgtgcacgtgtgtgtccccatgagtcctgtggcaccaccgagttgtcatgaatgctttcgtttaacgagtcaggagcagtttcccattttgtaggctgtttttctgtgacctggattttaatggcttggtcaacaggtggaaaagtatccacctttccttatcagtctggaggctggttggttttttctgcgtcgcctgcgtcaccacttcctgatgtcagcgcacggggctctgcgcccccccaggactggaggctccgtgtagatggagacttttgtttttgtcccatcctcctggcatgtagaaggccctcaaatacttgttgaagaataaatggacgggctttggtattttataacctagcaatgcaccttttggttgtttccaggtttactattaaaaccaacgtcttgatgcccctctttctggatgcttttggtgatagagaagccaaatcacgctggttttaagcaaaaatcatgtatttgctcctgaaattttcctttgaaaactttctgtgtgcggttgtacgtcagtatgtggttttcagccacactgggaggcgcctttctctctctttttgtcgctatagacattagtggaaagccacaagtagcgtgggggctgcctctagtcacgcttcagctgcaagtgcggtgtgagcatctatttttacctcacagtcctcgctctgaaaaattctgaccacttttatttttaacattctgctctattagctgggtgcagggaggaaggaagctcaaattagtcagtttactttgtatttatttttacttgaccttttcacttccacattttgagaagaaaatgtgagactctttcctctgcataattttcttccttgaggagaaaccattttcagtcatgcttggaaagaggtggagataacctcagggtagcatgtttagcgttttccattcacgaaacaaaccttaaaatgttcatctgtttattctatgaaataattagtttcttatttcccacgaatttgaaaaccagtacatttctgtgccaagtaatggctgtgttttcttgaccatccggcaagtctctacctgggtgtggtgacttggggaccgcgttgtcaaagagccagtgaggcgggggtgtggagaatttgt

SEQ ID NO: 156 - DNA, 26328 bp, Homo sapiens
  source 1..26328: mol_type = genomic DNA
acacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttgg

SEQ ID NO: 157 - DNA, 4037 bp, Homo sapiens
  source 1..4037: mol_type = genomic DNA
tctattgctagaaaacctatggctcatgtttatctactgataaagcccaaaagtcttgacttttcagagaatggcttttagttcactgaggcttcataacagatgctttttcatttcctatcataaagagagacagtattttactatacagctgtcatattactgttacaatccagctaatggctacagcacttcagaacaaaacagtagcaattttacaaaaccaacacattgttaatgtttttgatcatataggagacaggtactggagatatcagtttgctattaccctttctatatccagagtctctccacttttacgaacataaacaaaagaaagaagtccacatacacgctacagcagacccttcattctacctgcatccaacactcttgtcaatttcatttcacctactatcatcctttgaaagttttatgaagtagctggtccaacagatgggtggctagccctgcccaacacatgacgaaggaaaaacagctcttagcaagcaagacaagaaaatattaagtatgtccctttccctctcaaggctgagaacactgagactacctgagaagaaagcaaacaatcttttaacctttataaagaaaagttactggactgagatgatctgtaagtaacaaggtgattttaaaaagggagagagttcaaatgctaaaatctacccctcaagataaaacaggcacttgcccacacatagcagagaactggaatagacaggaaaaataaataaatccaaattagtttaactgggagctttttcatcaaagacagatgggaaacattcagataagcacactatcttgtttagaacacaaagctcaatagatctgtaggaggaaaaggaaaggcaacctgaaacacatagcctatatgcataaaaaatgactcattatggtcatattagtaaaaccagaaagaacaaaatggtagtggtatctgtcttctttgccccttccctgatcataagctttattaaccagatagcatctgatcctgtcttcaactgatgtatatctgtctttcaacatactacctaaaatgctccccaaggaaaacagtgagaccaattctgccagagacagtatctgccagaaccaagaagtcttattttcctttgagtgaaagccagtggatggggaagaggtccccaaatgccacttgtctgaatcttttaagatatgctctgaaacaagaaaacactacagattacattttagtagagatctaaaaatagcaaaagaacattccctatttttagatatctgacttccaagtgtaaaaacactaaaagtaaaagaaaccactgaaaactaactatatttttaaaagggttttaaaaactctgaattggaaaactgtttttagagataaaatttcaaaaatcctcccctgtgttgactgactctttgctcaaacttacccatctccaaaatttagtcctaatcctatgtgttattaagggcatttccacagaaccaaaagatggtacagaaaggttataccacaaacaagaaagaacagctaagaaaaaaaatttaaagatgctttcataaaaacatagagtctagactagtgattaaagacaacaatgtataaaacagcaaagcaatttaattgtctttcatttaaaacagtgccacagacaatacaacacttgattaaagaagacaaagagttttttttctcaaacaggtctccgcaactgaataatcttaaaaccagtaaccatctaattcaaagctgtcagaataactagaatttgcaatgagagaaaaattaataaaaaactgaaaatgcagtacatttcttcctccccatttctgtccactcctagtacaaatatgacccattttttttaaagaagcctgtggcaaataagatttgtaggaaattattagcaagttaggaaattaggatttatgtgaattacctgactgtactgccatcattaacatctcaggttccagtagagtcatgacggattcttccagaaacaaaaatccacaaatataatgaagaaagtcaaagtcacaggagaaaagctgtcttgaaagctttcacaaattcaatctgatgccttatgctcaaatcagactgtgagaatatccccttctcagtgcagttaccaatttatccacccttcaggcgagtcaagatgacacagatttgaattactgccgacaggaaaccaaaaagctctccagttaagacatactaagtgtggttagaacagtgagcaagctcctccccttgctattcgtctctgggggaggggagagacatatataaagagactttcagaaaacagatcaactgcttttttcctctcaagaagagaagatgaggttttgttcaaaatcccactataagagactgctgttaatgcagtttagtggaacagattaaacacaatccaaacaactcaagctcatgaaagaagcagtccaattactgacccattgatgagaggtggggaagaagattaaacacatataaacacatatatacaaaatgtaagctccataaattttctgaaaaagaattccaacggcttttttatatgtggtatttatagataacaggctaaggaagttgaacatttaactacagaagctcaactatttctccacccccactccaattaaaatatctgtttcaaaaagtcatctgaatacattccagagctgtaatctgtctttcagatctgtcagtcccctaaaagagcctcttacttgtgcctatattagacatacggtctgtgaatagacagtatactgatgttatttgatttcatttactttttttgtatgtttgagacagggtctcactccgttgcccagactggaatgcagtggtgcaaatgtggcttactgcaacctcgaccttccaggctcaagtgctcctcccacctcagcctcctgagtagctggtctcaaactcctaggctcaagcgatctgcccaccttagcctcacaaagtgctgggattacaggcatgagccactgctccccacagcacctttcattaactgatattcataacaatgatattaagattactttcagtctatctgactgaattttttaaagttggaaactaagaatccatgtttggtgtgtttatctagaattcttcaatctttctcgttaactatcagcctgtatgtgaaagctggctgctgccaatagcccagcgaataccttaatgcttacatagtaaacaaatggtaaataaaagcagtaggagaccttaagagagaaaatagtctcagaatgactgaaggcaatattttgttattagtaaagagaagcaatgcaaatttggggtgagggagactcagtacaagagagaaaaacttccttcctttctcactccaagaacatcatgtttaaaagaaaagccagaaaagctctatatagaactgtgggaatgactcaacaggcaatgagtagcagccagtgtgggctaaatgctgctctgggaaagcagaagcatctcactggccccttctggcaaccaaattttcaaactgacttaggaaaaacgggtaaatttcaactttgagtctacatgacagtctggtcaaaggttagcaactaagggaaaagcatccctaaaaggttgagaagattgagtcattccttggtccttatgtgggctgtataatttgctgtgtgagaggttttttctttttttttttttttttctttttgagactaggtctcactctgtcccccagactgagtacaatggcatgatctcaggtcactgcagcctcaacctcccaagttcaagcgatcctcctacctcagcctcccaagtagctgggactacaggcatatgccaccacacccagctaacttttgtatttttagtaaagatggggtttcaccatgttgcccaggctggtctcgaactcctaagctcaagtgatccccctgcctcagctacccaaagtgttgggattacaggcctgaaccaccacacctggtctttgttaaatttactttgt

SEQ ID NO: 158 - DNA, 12809 bp, Homo sapiens
  source 1..12809: mol_type = genomic DNA
cctcattaaaggaccccttattaccagtttagaagaaaaaacacagatgaacaaaggaattaaatgaaattgctttaatcccatgtccagagacaaccacactaaaatatgccacatttacatgctggattgtaactagtttgtggtttactttttgccatccttaaacttttcgtttggctgggggcagtggctcacgcctgtaatcccaacactttgggaggctgaggcaggtggatcacaaggtcaggagttggagactaggctgaccaacatggtgaaaccccacctctactaaaaatacaaaaattagctgggcatggtggcatatgcctgtaatcccagctactcggaaggctgaggccagagaatcgcttgaacctgggaggcagagtttgcagtgagctgagatcacaccattgccctccagcctgggaaacagattgagactccgtcttaaaaaaacaaacaaacaaacaaaaaaaaaaaaacaaaaaaaaaccttctcatttgtgattcttctcagagcttctgagctctactttctggagcgtcctttcctgcttcctttccttagggccattcctagaaatggaatccgtggcacaacccgtatcactggtattgaagtccccaccgccctctgcccactgccctggaggctgcaggagctctgaggggggcctcttctcccacctttcccacccgttgccgggcactgggttgaaagaggcttgtctctgcccccttggaactggggcctcttccaagttagagtgaggggtcagagcaagtctcccagtgctcccccttcctggacaccctcctgcccccaccgtcctggcactgggtgctttcctcatgttgaccccatcaggccttcacatacatatacatagtgacagccatttgtccaatgaaggaagtggattccagcccctcccagggactgatgtccaacccccaacaccaccccccaccccccaccacacacacaccttcctccccgtctcaatctgattcagtggtcagccagcagccataggtaaccataactactgggtctgtgccaggcactggataccctcttctctccatgggaacacctggccgcggggagtgagtggagcaggagagggcagctgtgaacacagagcccagctgaccctgactggctgagtcctgggatctgatcgcccattcagctgacactgccccaggtgcctggccatgtgccgggtgaggggatctggagatagagcagcccggccgaggagtgacccctttgccctggaccccggggtctctcaccccatcaaggctccagggcagccaccccttatctcttctgcctgcccccctccactaccactaagcctgtgtcaccaaaactcatccattgatccaggcttaaaataacccctggcatctgcagcaagccccgcggggcgggcagaggagccgagtccctgctcctgaagggcacccgccccgcccccagctcccaatgctggcagctcgagtgtgcgggtgtctgcgcgtgtttgggtgacagcaagagtgtgcatgtctggggctagcatgactatgagggccttccctgcacggtgggcatgtgtgtgcacacgtgtttgtcagcatacatgctcctgtgcacgaacggccttcctccatgtccagccctcacctggtgctcagttctggctggggaaggctgggggccctgagaggtgtggacatgacaaacagcctgtgctgggcctcagtgtccccattttaggtggtgggtgaccagtctgccagctctgctgagccctgggaaaggtttgggatttcctagagagaaactcaagactcagagagaggaagtgacttgctgtgactggcacacagccaggaagggcagggtctggcctggaacctgcactatgagtcccgaatccacattctggccagttcagcacacccgggaggcactcctaccccacgacagggcccttgccaacacctgacccaggctcatttgccccctgtctggtcacgcaggctgccctctcttcctggaacccctttccagccccacatgcccagagtttctaggttttatttatttatttatgaaacggagtctctctgtgttgcccaggctggagtgcagtggtgtgatctcggctcactgcaacctctgcctcctggattcaaccaattctcctgcctcagcctcccgagtagctgggatttataaggacccgccaccatgcctggctaatttttgttttgttttgttttgagacggagtctcacactgtcgcccagctggagtccagtggcgcgatcttggctcactccaacctccgcctcccaggttcaagcgattctcctgcctcagcctccggagttgctgagattacaggtgcacgccaccacgcctggctaatttttgtaatttttagtagagacagggtttcaccgtattgatcaggcgggtcgcgaactcctgacctcaggtgatccgcccgcctcggcctcccaaaattctgggattacaggcgtgagccacggggcccggcctaatttttgtatttttagtagagacgggggtttcaccatgttggcagggctggtctcgaactcctgacttcaagttatcggcccgctttggcttcccaaagtgctgggattacaggtgcgagccactgcgcccagcctttatcctttattttggagccaggctgaccgggttggaattcctgctcttcagggccattcaacctttctaggcctcagttttgtcatctgcaagatgggctaccagcatttcggcagggttacagggagaagcagtgggccccagagacactgaagccaggctgagaagaccgtgaccgcggatgccacccacaagcctccaaggcctcattcctaagctaatttcacttccatttcctcaatgatgcagttacccaagaagcagaggctcttggggactctgggctccctgctggtgcaaatgccgataccaggaggggttctggagggagggcccacggctgtctttgtctcccgcgaggcaactctgactcaggctccagctgcccgtgggagggagggggcgcccgggctcctgaggtcgccagggagcggcgggactgggaggctccaaagccctcagtgtacgtgcgaatccggagcggacaccgagaccttagcgcgggaaccaagagaggacagagctccacggaggccacagcgcgtgcacggggacaggtgcgccctccccggcagcccccctgctcctcggtcacagttctgtgcggaggcgtcttgcgccctcccccctgagcctcgcccttgagtcggggccgtgggccgcatccaggcccccagggctcgggatgcgcgtgaggacccggactcccgagggcgcagaggtcgggagcccgaagcaggcgcccttggccttggtcccgccccttatccggtcccaagctttttcctcgccccttggccttgactccaccccttaggcatgccgctggccccgcccctttccggccaccttgaggcttgggggtccctcagccccgcctctcttcttgaccccgccccttggcagcaccccctacccccgccccacgtccaaatctcccggggccggtggtggccggggctgacggcggaagccgcgcagagactcgcttgccccgaagtcgctggattcgggcctggatcccagattatccgcagcctaggggagtggagagatgcccaaggttcctctgggtcccgggaccccagtagcgtccctccccccgtcccccacgccaaccactgagcgcccttcggagtcccgggaggaaagcgtaggggcggggaactctggcatctctctcctcccggttgctccccgactctgccccgctattccgctatttggggcagtcgtttctaccgcacccccattctctccccaccctcgggtcatgagggcaggaccaggcctgctcacacctccctgctgggggcgttccctggctctagcaggggtccctctgtccctacatgccacaggacctcttcaatctccaaggacagctaggtgggcctcaagagccccattttgcagatgggaagaggggcccagagagttgaggcccagtgagatgctaccagcttgcagggatagtgctgtgttgagccatccctgctgaaacgaaagtggggggtcaggccttcctccctggcctcaccagctgggcctccacaacccctcctggagcccccagcctctggctaccaggcaggaagtgaaaggggcctgcaggaagccccaggaggaagcgagacttcagccaggcctgcccccaccggccagggccctggggacctggtgggaatcagaccctccttcaggaaaagctggcccgaaacacaggctcagagagaggccttttcccttcagttcccacccgcaaaacggcgcttccagagtctgtctgggatccctcttatcaaaatgagagaacagttggggagaaaatctgagtagtgatgaaaccagggagtggggcctggcatcagtccccgagttctccgctcccaaggagggggtccgggccaatgacattctgctgggcaggcatggccgccaagcgcaggagcccagggttcgcccagctccaccacccacctgttgtatcttgggccggatcccattacctcacagggcctctcttttcctatctgcaaactggaccatataatccctcctcatggatgtgaaatggtctagattttcaggagaaaatttggaccaacagggacctttaaaaaggtcaaggctgggccgggcacgatggctcacgcctgtaatcccagcactttgggaggccgaggtggacggatcatgaggtcaggagatcgagaccatcctggctaatatggtgaaaccctgtctctactaaaaatacaaaaaaattagccaggcgtggtggcgggcgcctgtagtcccagctactcaggaggctgaggcaggagaatggcgtgaacccgggaggcagagtttgcagtgagccgagattgcaccactgcaccccaacctgggcgacagagcgagactccgtctcaaaaaaaaaaacaaaacaaaaaggtcaaggctggctgggcgcggtggctcatgcctgtaatcccagcactttgggaggccaaggcgggcagatcacctgaggtcgggagtttgagaccagcctggccaacatggagaaacctcatctctactaaaagtacaaaattagctgagtgtggtagtgcatgcctgtaatcccagctactcgggaggctgaggcaggagaatcgcttgaacctgggaggaggagcctacggtgagccgagattgcaccattgcactccagcctgggcaacaagagtgaaactccatctcaaaaaaaaaaaaaaaaagtcaaggcctttggcgcaacaactgtgctgggaaacagagactcctgcacaggcgcatgtggcctgtgccgtcttggccacaacagcaaaaaccaaagtatccaaatgcccaggtggaaaaccttaccatgttgaaaactttattgtggagtctctaaagagagagaaacttaccaaatattaatatgatggtcaagacatgaatttgtatgtatagaatgattacaattatgtagaaaaatacaccacacactcgaggcctggggttactggacacgggtcatttcttccctgactacatcatggattccggtccagaacttccagattgtctacaaaatgcctatcttcatttttttcacaaaaaaaaatttaaacaaacacaaacaccccacccccctcctccaggtgctcttatgaagatcaaatgaggtattgatgtgacggctctgggtctcagtttcctcgtctgttaaatgcatatgagaattatctaaggttccttcctgcccttctctggggaccacaggccaggaggagaaccttgcatacaacccctcatttttcagaagaaaaaactgagaactcaggggaaacttcctaccggctggcggggccagctgggacagagagatgcccaaggtttgcatgtctgagccccagaggggtttcacccaccctcggggttttcacctgctgagctaaccctggctgtagcaaaagatggggtgggagatgggggtgtccaggagaagatggggtgggggagatggggtggccaggagaagatggggtggccaggagaagatggggtgggagatggggtggccaggagaagatggggtgggagatggggtgtcaagagaagatggggtgggagatggggtggccaggagaagatggggtgggagctggggtggccaggaaaagatggggtggggcagatggggtggccaggagcagctcagactcccccaactccagatggaaggggagtggatggctgggcccatgtgggcctgaccccaccaaacctctcccacacctactgcttgtcacttgacctcaccctgtcacctggctccctgggggcaggggcatctgagatgggttcatggagcaaatagccaggcagagacctggatgtgagtggccactgtcttccaagctgggcacacaacaggtccttgggacaggaagcactgagtccagaggcctggcaagggacaggaggggcaggagaagcaggggtctacaggtggctctggtggcagctcagggggaggcaggcagaaaacatctgatgcacagaacagaacatgcccagggcccaagagtgggaaaacagcacccagaactccaccttctgactcctagtccagtgctcccttccaaagatgctaagctgcaacaagttccaaggaagctgcccagggcgaagtccaggtcaggaggttctgaccctgtgcaggagggcaggtaggaggcggctgactgagtgcacagtgtcgtccaggagtggaaagagatggtcttgtccccagaccccagagcaaggaacaccattgtaagaggagggagcagcttccactgtgacggtgggtgaccagggggctggcacaggatggccaaataagcccagcactggggggccagtgcttcaggggaacaagccagagagagaagggagttcaagggacctcatgtccacctggttcaaggtcacacgcctgccctggcctctacacaaaggagcctcctgtaggtcccagcccttccatgtttatggctaaatgtgctgtgtcttggagcagctggaaccccaggtggaccctgagagagctacctgccagcatgttccttcagctcgagtttggagtccagccctggaggctgcgcacctcctcccaaatgcaggcttgtggctctggaagctgccactggggtcaaaatggcatcttaggttctggcagattgggccaatctcagggttgaccctggggtacagatacctgagaatcagcaaaatccagctcaatcttttctcctttgttatttcttaaaataatcttgtactaaatcccaaagcaagcgaacccatgaattgattattcactgctgccatttgcatcagtttaaaagcaggacggctctgagggcaggtattaaagaaatagaggccaggcccggcgcctcctgcctataatcccagcccttcggggaggactgcctgaggccaggagtttgagactggcctgggcaacataccgagaccctgtctttaaaaaaaaaaaaaggccagccacggtggctcacgcctgtaatcctagcactttgggaggctgaggcgggcggatcacgaggtcaggagatcgagaccatcctggctaatacggtgacaccccgtctctactaaaaatacaaaaaaaattagccgggcgtgatggcgggcgcctatagtcccagctactcaggaggctcaggcaggagaatggtgtgaacccaggaggcggagcttgaagtgagccgaaattgcgtcactgcactccagcctaggcgacagagcgagactctgtctcaaaaaaaaaaaaaaaaaaaaaattagctgggcaaggtggagcacctgtagtcccacctactcaggaggctgaagcagaaagattgcttgagcccaggctgcaattagctggggacccatcgttgcactccagcctgcgtgatacagcaagaccctgtctcaaaaaaaaccaaaacacaaaacaaggccgggcatggtggctcatgcctgtaatcccagcactttgggaggccgagcagggcggatcacgaggtcaggagatcgagaccatcctggccaacatggtgaaatcccgtctctactaaaaatacaaaaattagctggctgtggtggtgcgtgcctgtaatcccagctattcgggaggctgaggcaggagaatcacttgaaccaaggagtcggaggttacagtgaggcgagatcgcgccactgtactccagcctggcgacagagcaagactcgtctcaaaaaaaaaaaaaaaaaaaaaaaaaaaaaatcaaacaaacacaaaaaaccacccaactacaaattaggcatcctcccacttggtcttttttcagattcattttggcttaatggtgccttccccattttaaaagcggtcttttactcatagtgccccagccttttgaaggcacaggaacaggagctgggctaccaccttcaagggctgtcaaagatggtgaggtctgaagccaaaggcaagcacaccaaactccatgggggctgaatgctgtggtctgtagtgtctgtgcttctgcagagttagcctggtcccagaaagagggcatgtgcatgctggagtgaagagctgaatttgatttccaagcccctggctgggggtccagagggagggcaggggccacctcctgccggctccctgctattgttgctcagggccggccgtcttggtggtcaccagttcagtggagcccagctctgtggctggcacagggacactgtggccaggtggggtggttcctgggtcttccccaggaggaggccaggcaggagctgtggcatcagagattcccggagacagaatgatgaccttgtccaggggctctggggctgcaggcagagggggtagaggctccgtactcagtcacagccttccctccctcccctagaagactcctctggaggggcagtcctccgtcaaatgaagcccaatgcagggtggggaggggtggcacctggctgaccctgagtccagaggcctggccagtggggagctggcagggcagggagttggggagctggggctcagtctggcaaactcttcagggatttatgggggaaccaagctccgttagactcccaaagggcaggacagactcctccctcagacggggcccccttcctgcaacctgtctcttcctcacactggggtctgtcagggcagagctgttcctggctccgaccagggtctcaggggcaggactatgtctccctccccagcctgagctcctcagcgcaaactcttttccactctgtctccgtttccccttaaagcccttctctccccctcaggggccatgcatctccccctagaccgtcccgacaccccagcccctgcgccccgctcagactggttcccctacacacggaactcaccgtccttgtctccgtcgggggcctctgcggaggacgcgccgcgaagccgccgctgtcgccgcctccagctcaccagacccaccaggaccagcgccaggaccagtgccaggcccagcagcgcgggggcgccaaagagcagcccgggcaggggcagcgccgcctcgccggcccccgcgcccaccgactcctgcggctgcagcgccgtcctgggcgcagggctgctggccccggctgcttcgggaggggacagggagggaggccagggggccgaggggagggaggagcggggacggggaggggcggaggggggcgaggctggccggggaggggagggacagccggggggcggtggacaaggggagggagagaggcggcggtgagggccacgcggtgatcgcgggcccctccaggccctgcccacagggtcctttcagccctcggcgcccccgggggtcggggctctgcctgcgccctggcgatcggggccccgttctccccgcagctgccggcgccgcgcgccccgtgggtcccccttacccggtttcggccgcggcgtgcgcaggagcccgcaggccacgcagtggcggaccagcaggtcgaagcactcggccgggacgcagggcgtgggggctggcgcgtccctgccccgcaggctccggggccctcgcctcatggtgccgacgccgccgcacaagctgcggggactgaggctgagctgggctccggggccctcggggaggaagcggggggcggggggagcactctgccctgccccgcccccgcctgctgggtgggaccgagctcgcctggggcccccctttcttttctttttttttttttgagacggagtctcgctctgtcgcccaggctggagtgcaatggcgctatctcggctcactgcaagctctgcctcccgggttcaaacaattctctgcctcagcctcccgagtagctgagattgtaggcgcccactgccacgcccggctaatttttgtatttttagtagagacggggtttcaccatcttggtcagactggttttgaactcctgacctcgtgatccacctgcctcggcctcccaaagtgctaggattacaggcgtgagccaccgcacccggcctggcctctctttctacctgtggttccccaattcagcccctcaaccagcaccgcctgggtgggccctctgctgggtgctgggaggtgtctgggggcagaccagagcctcctcttgggtagggagggggatggaccccgcagccaggacacagaccctgagtggttcctctgctccgtctagccaaagcctctccatgaccccgagtgctcccctgccatctcccccaacccacctgtctcctcctctcttcctgcccttcctggacagagctggttggggatatcagacacctgctttttttttttttttttttgaaaaagagtctggctctgtgcagtggtgcaatctcggctcactgcaacctctgcctcccagattcaagcgattctcctgcctcagcctcccgagtaactgggattacaggcatgcaccaccatgcccggctaatttttgtatttttagtagaggtggggtttcaccatttggccaggctggtctcgaactcctgacctcaggtgatccgccctcctcggcctcccaaagtgctgggattataggtgtgaagccacagtgcccagcctgacatcagacacttgtaccaggcccaagtagcatgtgggtctgccctgagggaatctcacacttgtgctgatgggggaagacagcctcgcagcaagggcaccagctcacgtcatcctggaaggtgggccggaaggcttcatggagagggcgatggtgaagtgtttgccagatggactgaggtctagggagcagatgggggtgaaggccaaaggggagcaaaggcttggaggcccaaacaggaagtccagggagtgctgggaccgaaaggctggactggggccttatctagcacattagggagcttggactgtggctgggggacacgagggagccactggggctttgtgcagggaggacccaggaagatctgcctatgagtgagggaactgtgactgcagtggagggaagcccgcccacacctgctccttttctccagggctatgtgtcctctcctgctcacctctgtgtctcactgcgggcccctcctgtctatctctgctccccagtgtttggggtccccaactgtctgtcacccgtgtctctctcagactgcgtctcagaaacacacacaagcccctccgccctcctggtcacatgctaccccctccccagggccagggctggagggaactctgggagctcagggctcagcagagagcatggggttaaatgccacacatgccacccagacccctaagcactcagggctggggaagcacagtgagaggagaaactcaggggctggggagggagcctgggggcagagggagaccctgagcagcagcgagggggaggcaaacactccaggcggagggctgcaggggctaaggcttggagagatgaaaggggagcctgagctgctctgggggcaggcatggccactgccacaggggatgctgggagggaggagggagcatccgggctgcggatgggcagggcaccagtcccggggcagtacagaacctgggggtgtctgggtaggagggagattctgagctgtacctgcaagggtccctctctctggcactgtggcccacgtccagggcaggtggcccagggcaggggatgatgcagcggctggccatggagtgaggggagcaaggccgacccccaggtttccagcttgggagaccctgaaggttcacaaagaaccccagtcagccagccctgactggtgggcgctggcccaccctctccatcccctgtacatgggccagcagctcccaggcaggaaggtgtgggcggaggggagctgcaaaggagaagtggggctgggggcaggtgtgggtgagcgtgggtgtatggtgatgtgggggtgggggcaggtgtgggtgagcgtgggtgtacggtacagggatgggggacaggaccctggaggggagccagggcagggaaggcctctctgtgaggcagagaggtggggacaaagccagaagactgagccataaccctgccaccc

SEQ ID NO: 159 - DNA, 17431 bp, Homo sapiens
  source 1..17431: mol_type = genomic DNA
attcacaatcagaccaatgtggggaatgttagtttactcctcaatgtattcttatttccccgtggcttttttttttttttttttttttttttgagacggagtctctctctgtcgcccaggctggagtgcagtggcgcaatctccgctcactgcaagctccgcctcccaggttcacgccattctcctgcctcagcctcccgagtagctgggactacaggcgcccgccaccatgcccggcaaattttttgtatttttagtagagacggggtttcaccgttagccaggatggtcttgatctcctcacctcgagatctgcccgcctcgccctcccaaagtgatgggattacagacgtgagccaccgcgtcccttttttttttgagacggagtctggctctgtcacccaggctggagtgcagtggcgtgatctcggctcactgcagcctctgcctcctgggttcaagccattctcctgcctcagcctcccacgtagctgggactacaggcacgggccaccatgcctggctaaatttttttgtatttttagtagaaatggggtttcaccatgctagccaggctggtcttgaactcctgacctcaagtgatccacccaccttggccaacacgcctggcctaatttcttttctttttttttgagatggagtttcactcttatcgcccaggctggaatacagcagtgcgataagcaacacccaactcagctcactgcaacacccaactcccaggttcaagcgattctcctgcctcagcctcctgagtacgtgggattacaggcacctgccaccaggcccggctaattttttgtatttttaggagaggtggggtttcgccatgttggggaggctagtctcaaactcctgacctcaggtgatctgcccactttggcctcccaaagtgctgggattacaggcatgagccaccactcctggcctaatttctttattcaagtcttttttttttttttttgagatggagtctcgctctgttgcccaggctggaatgcaatggcacgatcttggctcactgcaacctccacctcctgggttcaagcgattctcgtgcctcagccaccccagtagctcggataacaggcacgtgccaccatgcccagctaacttttgcattttagtagagacggggcttcaccatgttggccaggctggtctcgaactcctggtctcaagcgacctgcgcgcctcggcctcccaaagtgctgggattacaggcgtgagccactgcacccggccaccatgctctacttttaattcactgaatactctttttaaaaagataatttgggcctggtgtggtggctcatgcctgtaatcccaacactttgggagaccgaggcgggtggatcaccagaagtcaggagtttgagaccagcctggccaacatggtgaaaccctctctctataagaaatttaaaaaaaaaaaaaaattagccgggtgtcgtagctggcgcctgtaatcccagctacttgggaggctgaggcaggaagaattgtttgaacccggaagccagaggttacagtgagctgaggtcgtgccactgcactccagcctggctgacagagcgagaccccatctcagaaaaaaaaaaaataataataaaataacaagatagtttggggtcttcagagagaagggggtttctgtcgatttttgtgccccaattctcctgaagacaccctcacaaggatctgatgcaggtactattaggacattttccagatgagaaaacagaggctttaaggggcaagggccctctcaagatgagccagcagatgggaggggcctgcagggggtctgtgtccacctgactgtgaagcgtggcctgggccctacatgcttcagggacggggttggggaaagtgagagcactctggggatgggacaagcacagtgtcatggggagcagtccttggggacagagaggcccagtcccccagatctggatgtgaaactgctctggggcctgggatgcactctgtacttcaaaatcagttttcgttgtaattatgcagtagtacctgaacacgtgctcaggaaaaacctgcaaacaatacagaagtctatgagtgacaaagggcgtttccccacggtccccagagggagtctctgttttcccttgggagcctttcttcactgcctggttctgtgcctttgccccctcgtgtaggtgtacacacaaacagcttttcccgtgttccaggaatggggtcagcagtggagatggctctgctggctgggttgggcctgcagggcttcgagtcagctctcttggctccattttgtctcatgacagcgccaggaccaccccttgtggttatttcctttcccttctcctgtatttaaaagcccccacaaacaagtacaatgctacagagtacctcttgctggggccaggggaaaggatgcagtgccgtgggcctcggttcattgggagagggcagagtggccacggaatcagcacaaagtcctggcgagtccagagcagtgtgacccagaggcagaggcctgggagtccccagatcccgttcctccccgaacccacaccaggggagggcaggtcacgcccttccatgaagcagtcacaaatccttgcctgggtcttcatgggctggagctgcctgtcatccagcccgccactccatgcacacgtgcgcacacacgcgcgctcctgcactccacagggtctggccagggcaccccagccactctcagcatggccccgggatagaggacatgggccctccatgtgagactagagggcagaccacagccctttagccacagggagcaaagcccccacctcttgggggccaggtgtgtgaagtagagggaggctgtaaggccagggtaggcaagggggagaggaacgggggcccccagggccaacctcccaggccttattcagggtaccacgcaggaaggcccttgtgaacgcagaggccgacccctgcgcggatgcctccccgtcactcgccactcactcacttagcacctaccaggcaccaggagctgttttgggttctggggaaatagcagggaagcagagaggaaacccaaatgggacacaacgtagtgggtggggaggtaaggagtgctggggagaaaaagtcagaagggcagggtgctcgagggttatgggtgcaatttcaaacaggggagtcagagaaggcctggtggatggtgacctcggaacagaggacagggtggagcgatccccaaggatgtctgggggaagcagagaaggcccagtgaccaggaaaagggctgtgcgcaaagcatctccctacccggccgtctcctccctcagccctgtgtggggctagcacgactggtcccactttacaaagagggaaagcaggctagagtaaaggggcccgccaggcagcccctgagcctgccacactacacacatcagtggggtcctcttcccgtgtgcggacagcggcagggagagggggtgggggtgggggtgaggcccaggggtctgtgtcctcacagggaggctggccaagcatattggaggaggagggctgggggaccccttgggcctggccagctcgcaggggccccaagttcggctggcataccctttgatggaagagggcggtccagggaaggctgcctcctgtgcaggtccggggctctgggaagtacctacccactctccccagggagctgccctcagcagcccccagtccacagcatcccatactcaggtgggacccgcagacttagggtacacagcctggcagcccaccccactgtctccctcagcccccaagtgtgagacattctttcacagagactctctgcctgtgtccttctgaccccagggtacactggaggggaggggctaagccaacagaaccttccagaaaacgtccctttgtgctcgagccctgccagcaggcctggcccagcacccctgatgcgtgtgggttgggggcaactgtaacagggccttgtctcaagaaccccacggctctcctcgcccaccagcctgccagcccgtaccgagccactgtctgtagagggtggaagggctggcatggagtcaggctcttcagtttctctccaagcctcacaagacctgaaaaggggggcaggcagtggggcttggagagggaagtgggctgccccaagtcacactgcagatcagccacagaccccaagtcggtgggactcggaggctgctcctgttcccactgcaccacttcccctctgcagctgggctgctcctgcctctgctcaccgggggtgcaggagacacggggcccaggctgcagagcccctccttgctaggaaggtcctgcctccttggtagggatgggaaacaccatcagattgaggccaggacactcgggcctggaccactggccatggagaacgtgaactccctggggtcccaaggactgctcacagccaggtggaatgagggggacaaatgagtgtgtgactccgagtaagctctactcctctaagagtggggcccaaacaccaccttccttccagcttataagagcacggacggggcagcttccaggcccagctgaagaggcgccgcttccagtagccttcgcccccccattcccagcctgtaggcctagggggttcttgcccgccttcaacatcctgcaatgaccacgtcatgaccatggccaccctgaggcatctgacatttgtttaaagctttatgttcaaaataatgggcttgaggccagcaatttgagaccagcctgggcagcatagcaagaccccatctctaaataaatacataaaatagtggcttcttcattgccagtcctcaactagctaggaagaaaggcatcggttagcctggcgccacgctacagctgaggaactgaggcttgccgagggtgagtgacctgcctgaggtcacgccaccaagcaagcagccaagcccagcctctcccatctccctccaccttacctcagtaccaagccccaattccggcacacactgatcttccattacttccctcagccaaactgtctcctggacaatgtcactgggtctccagatggcgtgaagcaaccccactctctggccacccatcccccgccttccagggacagcaggtctgagggcacctgcctgccatttaagtgtggctcagctctgctgtgaggcaggggcaggccagcccccaactctagaggggaggcctcctggttccagggcccctgccaagctcagctgggagctggcggcagtgacagcactgtgttccccagtgcttggaaggttcccagactcttggctggagaatgcgatgccacttctcttgttaaatggtaccaggtggcaaggaaaatgtggcacagggacctgagagaggtgccccatgcgggcatgggggggagggggtgtgggggaaggcctctcctcctggtcgccagcaaaaagtgacatcccagatcaggcaggctgcatccacaccgccttcctcccctgcttggacacccattccatcagccccgccaaagacctactctaccctccagttaccctgcaaagacacgcattctggccaaggacagaagggccaaagacaaggtcactctctgggaaggctggccttccgggctctgctgctactgcccatcccttcagggaccaaagtgaaggttcacctccagcctcttccttctgccctggagcctcccctcctcaagcagaggctggcttccccgaccaagtgcccgaggggctttttgctgcgggcgaaggcctgctcaggcccagagcctgcaccactctgctcccacgctaagggcctctgccctcgggcctatcctgccaccccctgccctctcgcgatgctgtgttctagtggtcccatcctgaggcaggaaccatggcttgcagactgctgctttctggagcacacgggctgtctccaccttctgtattccagctcagggcctggccagtggagatgcccaaatcttttttttttttttttgagatggagtctctctgtcacccaggctggagtgcagtggtgcaatctcagctcactgcaacctctgcctcctggtttcaagtgattctcctgcctcagcctcccaagtagctgggattacaggcgcatggcaccatgctcggctaattttgtatttttagtaaaggcggggtttcaccgtgttactcaggctggtctcgaactcctgacctcaagtgatctgcccaccgtggcctcccaaagtgttgggattacaggcgtgagccactgcgcctggcctccaaacctttcttcaaggattaggcaggcacacagaaaaactggagagaagcagagtggggctggctctgctgccagttagctgtgtgactgtgacacacctcccatgacaacggtctgtttcatgaactgtgaattggggaaacatcatctacctcacaggtctgctgtgtgagaagagctctgtgaagcatgacgtgcctgcaaatgtcgggtgacatgtggggcctcgaccggaatctacgtggctgaagtcctcagcggagcccaagggactgccaggaagtcagccaggtgtctacaaacccttactgagcactaggggtggggcctgagctaagttccagaaggaacctacagaaaggggcagatagggccgcatccccgacacctacaaggagttagaaggcggcccacccctcagtgaagggcatgggcccagctgcgatggtgacatcaaagcagagaggccttaggccggccgcggtgactctcacacctgtaatcccagcactttgggaggccaagggtggcagatcacgtgaggtcaggagtttgagaccagcctggccaacatggcgaaacctgtgtctactaaaaatacaaaaattagctgggcatggtggcgtgcacctgtaatctcagctgctcgggaggctgaggcaggagaatcacttgaaccagggagcagaggctgcagtgagttgagatcacgccactgcactccagcctgggcgacagagcaagactccacaccccaccaaccaaaaaaaaagaaaaaagcagacaggccccgaggtgctggtgcagtgctgcccagggcttcaactggggtccatcctgaggcctgaggctggtgggcatgccctggcacatgcagggtgaatgtggggagggcactgtcatgttccaagggagtcaggacctggctctctatgggatttctagagtccacttctgatgcctctacaatctccaattagacccaagggagaaggaaagcaactggcactgtacaatctctcgccatcaaccccaaaatgagacctccagccagcttttctcacttcttgcaaacttctgacagtggtgtaattcctaatttgcaccagtttttgaactccgctgtgtgatttcttttttggagatagagtctcgctccgctgcctgggctgaagtgcagtggtacgatctcagctcactgcaacctccgcctcctgggttcaagcaattttcctgcctcagcctcccaagtagctgggactataggcacagactgccatgcccggctaattttctgtattttagtggagacggggtttcaccgtgttgccaggccagccacaaactcctgagctcaggcaatccgcccgcctcggctttccatgtgatttcaaatagttactgttcactgagtgcctacctagcaaggtgcaaggcattaacacatgttatgaacacagcaacctactcgcaggcatggggggtcacacagtcccaggcatgtccatcgtctcattcaatcctcccaacgtgacaaggtgagcagaacctcatctccattcacatctgagaaaacaagctccaagaggcaacaaccaggttctataatagcagggccaggatgtggagtctgactggcataacgagtccaagctccccttaccccgccccactcctttttttttctttgagacagagtctcgctctgtcgcccaggctggagtgcagtggcgcgatctcagcttactgcaagctccgcctcccaggttcatgccggtcttctgcctcagcctcccaagtagctaggactacagatgcccgccaccatgcctggctaatttgtttgtatttttagtagaggcagagtttcactgttagccaggatggtctcgatctcctgaccttgtgatctgcccgcctcggcctcccaaagtgctggaattataggtgggaaccaccgcgcccagcattttttttttttttttttgagacggagtctcgctctgttgcccaggctggagtgcagtggtgtaatctcggttcaacaccacctccgcctcccaggttcaagtgattctcctgcttcagcctcccgagtagttgagactacaggcctgcatcaccatgcctggctaatttttgtatttttagtagagacagggtttcactatgttggccaggctggtctcgcttttttttttttttttttttgaggtggagtctcactgtgttgcccaggctggagtgcagtggcacagtctcagctcactgcaacctccgcctcccgggttcaagtgattctcctgcctcagcctcctgagtagctgggactacaggcgcccaccaccacatctggctaatttttgtatttttgtagagacagggatacaccatgttggccaggatggtctcgaattcctgacttcaagtgatccacccacctcggcctcccaaagtgctgggattacaggcgtgagcctctgcacctggcccaccctgccctactcttaattgttctgagtcagtttcctcatctacaaagtcaaagtggtgaatgagaccagtgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcctgcctacttccttcaggtctttatttatttagaagtcctgtttgcaggggcgttccctggttaccctgcctaactcttgcctgtttaccaccacctgacacgccacgcctccactttccagcacgtcatttaccccatttgtttccttgactagaacaaagctggggctttttttgttttgttttgagacagagtctcgctttgtcacccaggctggagtgcagtggcaccatcttggctcactgcaatctctgcctcccaggttcaagcgattcttgtgcttcagccccctgagtagctgggattacaggtgtgtgccaccatgcccagctaatttctgtatttttagtaaagactgggtttcaccatgttggccaggctggtctcaaactcctgacctcaggtgatccttccacctcggcctccctaggattacaggtgtgagctaccgtgcccagcaggaagctggggtttttgactcttttgttctgtgctgtgtccctggagcctagaacagtggtcggtaccacagaaactcaggaagtatttttttaataagtcctctaagtttggtggcctttgttcctgaaatctatctctaggctgctgaggcttgggttccacaacctgcctcctgcagcagcctcgacccagcctcctgcctctggccaggcttcctccaatccacatcactccagagacgtgacccaaatgcccaggtctgaccacaatcatgactttgctcatgacatccaagaagaaatgacctaattctaccaccaggctcccagagctcagcaaatccttctgctgttgcttatgttacatgtctgcttatttcatgagattctgagagggcagggccaatatctgactcatttgtgttcccagggcccagcacagagccctaccagcagacctaggcaattatttcactgggccaatcacataccttcctgtgtttcctcatcaatggaacggggccggtaattcctgccacgcaaaggcctcaagatatatggtggggcttaaactcaattatgcagaagagtgttctgaagaggacaacaccagcatgaagaaggaggccagttcaaaccctgggtgctccatctgagggatgcaggcctatgtcctgagcaggcatttctgcagctcctgctgcggcgggaaccaggctgggacctcctgcttcctgcccaggccaagagagaacccaggacctggcctggcctgccacctcatggccacagacagaattacaccacttgtcacagggtgagtaggcaccactgtcccccaccagcacctgaactatggagcaaagatcgtgactcccctttagagatgcttcgtggcagacaaagtgacctattcaaagtcacacggtcagcaggctaggacagcagaacagctggctctacccctcactcacgagctgtctgaccctgagcaagtcgcctgttctctctgggaggaaagcctggcggggcaggcacttcaggtgtgcccaggcctcagggtcccatctgtgagatcagagtgctgatctggtcaggggctcaaaaagtagtcatcaactaggaaatcaaatgcgtgatagagtcaagtgtgtatcatgatcgatgcatcgagcaaggggcaggcctaatggctgctgccacatgagacagtgatgagacctgcccaatcctaatgtgatatgaaaacatccccatttctactggcgacagccacagactgctatcctctgaattctgcccttagaccagaggagtgccctgacaccaggataagggaccctggtctagacagtggtgatggattggtggtcacagatcatgtgctgactcggttctccctgcatttcatcactttgctttcggtaacaggcacaagacccagaacagagcagaaacacaactcttcgaaatgtatctcaaaaccaataaacaggtttccaaaggaatggagcaggcctggcacatgggtgtggcagtgcgggccctgggacccctcagtagacccatcgcggggagcacatcaactcctgctgaggcctctttagcaaaaagtcatcaggatttatcctgcataaaaagcggctaaaggccaggctccgtggctcgctcctgtaatcccagcactttgggaggctaaagtgggaggatcgcttgaggccaggagttcaaaaccagtgtggggaacacagcaagacctcatcgctatattaaaaagtaaataaacagtggccgggtgcagtggctcatgcctgtaatcccagcactttgggaagccgaggcgggcggatcacgaggtcaggagattgagaccatcctggctaacacggtgaaaccccgtctctactaaaaaatacaaaaaattagctgggcgtggtggtgggtgccggtagtcccagctacttgggaggctgaggcaggagaatggcgtgaactcgggaggcagagcttgcagtgagccgagatcgcgccactgcattccagcctggacaacagagcaagactccatctcaaaaaaaaaaaaaaagtaaataaataaataaatacttagctaggtgcggtggtgcatgcttgtagtcctagttactcagtaggctgaggtgggaggttcacttgagcccaggagctcaagtctgcagtgagccatgagtacaccactgcaatccagcctgggcaacagagcaagaccttatctaaaacaataacgacaacaacaacaacaacaaaaaggctactttcctacccctcgtggttagtttcaccttgtgagaaacaccaacaggatccagttggggcagaattccctacatatgcatccaaccatctacccacctacccaacaaacatccctattgcctgctgggtaccctagcttggggtgggacgagacaagatctgaaatcagagagttaaggggaaatcaggcattctgactcccagaggacacaaggatgcaccagttaaagagacggacatacgcttggcctcacaatcacttacaccccagcaggagagtggactcacaaatacatacacataagacttagttataactgagtatgcagaaactcagcaaaagcaaaagcagggcagcacgtgctagagcctggcatataagatgcactccagatgaaagcacatcatcctcacttcacacctgtgtaccccaaggctcagggtgacctgcccaggtcatagccagtgagtagaaaagccactcaaaccaggatcctgtgtctccctccccttcaggagctgcctcgctcggatactaagtccttcgataagcattcccaatgtgcccactgtgtgctgaccaccctttccccgcacccgagtatagtgttggtctctgtgatcagcatgctcacctccaggtcacagtagagcagggggctttgataggtgtgggccagcttcaccacggtgtgccggtgaatgctgcagtggctctcccgcccagctggaaagaagccatgagtgctatagctgcaatctctaccttcctggctggaattcaggaagtgctgggcagagtcactcacttccccactctggggctcagtttctttctagtcgcgagggtgacagtcctattctactttcttttctaggtagtcaagaatatcaaattagacaatgaagataataatagctcctaccccactgagtcactctagagtcagtgagttgacatctagaaattacttggcctgcatttgctcaccaatgcttcttgagaattatctgtgccaggcactctgctcaaggagctaacagttcagctgggaaggcagacaggtcagacacctcatgcatgccggagtgacactggggctgagttttgaggtatttgtaggggttagcaagacaaagaagaggaaatgtatttgacagaagcctagagtaaacaaaaagaggacggccgggtgcggtggctcaggcctgtaatcccagcactatctgaggcaggcggatacctgaggtcaggagttcaagaccagcctggccaacatggtgaaaccccatctctactaaaatacaaaaattagctgggcatgatggcgggtgcctgtaatcccagctactcgggaggctgagatgggagaattgcttgaaccagggagacggtggttgcggtgagctgagatcacgccatagcactccagcctgggcggctgagcgagactccgtctcaaaaaaaaaaaaaaaaaaaagggacgggccctgtaacaggacttacctaggtgtaaaccttggctctaccacttttcatctaggggcctggggcaacttaacctcatgactgtaaaacagaggtaataacacctacctccaataggaatatgaaaacaaagcaattaccgtgtctgcctcacagtgacagctcaaaagatgtcagccattattattttcactgttaatattacaaagtctcaggaacagcaggactttttcagagaacgataagctgacccagagaaggagagtcaccggagatgagactagctcagaaggcagaggccaaactgcaaagtgttttatgtctttagagtttggattttaccgaaagccacaggcaaccactaggcaactccaagtaatggcagagttatctgctcatattcactcttagaaaggctgacaacaggtcagattccaaagtatgtgtatatgtgttctttcggtttttaaatttaacttttattttaagttcaggggtacatgtgcagatttgttatgtagttaaaacttgtgtcatggggtttgttgtacagatcattgtcacccaggtattaagcctagtacccattagttatttttccagatcttctccttcttcctgccctccaccctccgataggccccagtgtgtgtaaaatacatgctctttccatcacccagggtgcctcagcaagaagcctacggccgccccagctttcccttggctgggggtgggcagtaacaggcgaggaacgtacttaccacctgtggcgaggaaacacaccttccccaagaagaagctggcatccacatggcgcagggactcctctgtgttctggagactggggtggccaggccagggtgagaaaacaaaccagagaacaaaactttacaacggagaaagcagaagtccttgcttctctgatcctagaggccagagaatgacaagagggtgactttctctggagaaatatttgtcctttaattttttttttttttttttttttagatggagtttcactttgttgcccaggctggagtgcagtagcgcgatcttggctcactgcaacctctgcctcctgggttcaaatgattctcctgcctcagcctcccgagtagctgggactacaggtacatgccaccacgcctggctaatttttgtattttagtagagacggggtttcaccatgttgcccaggctggtctcgggcaatctgcccaccttggcctcccaaagtgctgggattacaggtgtgagccattgtgcccggccgttgtgtattttaaacattgtgcactgaccactggctcctctctcctcaccttacagattgacctcagccagcctctcccatcctcaccacttcccatcacaagttaggtcaccgtctcagcacagtcctgagccaggcctgcctgagccctgactgccccttcctctggctctcacctgtatttgctgtgaagattaaccacaaacacgatcaggtcaattcggggccgattcacactggagggcaaagggagggactttgccaagtggctgaaaaacaggaaattgcaggactcaagatatccgtacccccctcatagcgaccgtttaaatgctgcccttcatgtggaaagaggccgtcaagggctccccacctcatcctagccacccgaggctcttgtggccacgactccttgggccagcacagaggcaggacaggtccggtcctattcagattactcctgtctgattccctctgccagaaacgggctctgtttagtcaccacctcggcaaggggaggttgggatataagacggcatgggactagccagctacgctgcatgctgggagaaggaccagcctcagaggagggggcgctgggcttcggagtttagcagctaggaccgaatccctctggagtgagagacacgtgggcccaggccacagccgcggctacttacaccttcagctcggaggcgcagtcctctttgagcatcgagtccgccagctgctgcagaagagcatcctccgtgcccaccagctgcgcagggagagagagcggacagtcgagccctaggcacagcaccccctggggagggcctggcccttcgacccactcccggggggatcgggacaccgccagcaggcggctcggaggacatttcccgagaagtggaccccgcgaagcggcacgggctgggggcctgaggtttggacccgctgcaggcctgtgggcaccgcactctctactacccgaccctcgctcccaccgccggcctctccaggaggccagacccccagacgcgggaaaaccaattccaggcgcgggaactcgccaatcagaagctgggaaagggtccgccgagcacctattggtgggtgcgtccctcaacctcagagagcggctactccaattggttcagagcatggctctccgcctattccccgcccccgccacggtagcgcgcgctggcttggcgcctcagagagctcagttgacctagtggctgaagcaccgcccaggaggaaaaaccggcgggggaagcagggccgcctgcacctaccaagatggtggccgtgttcaggccgggcagcttgtccaggggcctcaacaccgacatcacagccgcaggaccaaccgttgctcctgcggtgcgcgccgatctttcaaaccgccctgagtccagcccctagagcgcggcctgggggcacgtgcctccttataggcggggcttcgcgggacgggacggggcctcttaaaggaaccgaacctttatctccttttctgaggggcgttccagcgctacccgtggaacacgtggtggacaggcctttggttccacgc

SEQ ID NO: 160 - DNA, 19969 bp, Homo sapiens
  source 1..19969: mol_type = genomic DNA
attcacaatcagaccaatgtggggaatgttagtttactcctcaatgtattcttatttccccgtggcttttttttttttttttttttttttttgagacggagtctctctctgtcgcccaggctggagtgcagtggcgcaatctccgctcactgcaagctccgcctcccaggttcacgccattctcctgcctcagcctcccgagtagctgggactacaggcgcccgccaccatgcccggcaaattttttgtatttttagtagagacggggtttcaccgttagccaggatggtcttgatctcctcacctcgagatctgcccgcctcgccctcccaaagtgatgggattacagacgtgagccaccgcgtcccttttttttttgagacggagtctggctctgtcacccaggctggagtgcagtggcgtgatctcggctcactgcagcctctgcctcctgggttcaagccattctcctgcctcagcctcccacgtagctgggactacaggcacgggccaccatgcctggctaaatttttttgtatttttagtagaaatggggtttcaccatgctagccaggctggtcttgaactcctgacctcaagtgatccacccaccttggccaacacgcctggcctaatttcttttctttttttttgagatggagtttcactcttatcgcccaggctggaatacagcagtgcgataagcaacacccaactcagctcactgcaacacccaactcccaggttcaagcgattctcctgcctcagcctcctgagtacgtgggattacaggcacctgccaccaggcccggctaattttttgtatttttaggagaggtggggtttcgccatgttggggaggctagtctcaaactcctgacctcaggtgatctgcccactttggcctcccaaagtgctgggattacaggcatgagccaccactcctggcctaatttctttattcaagtcttttttttttttttttgagatggagtctcgctctgttgcccaggctggaatgcaatggcacgatcttggctcactgcaacctccacctcctgggttcaagcgattctcgtgcctcagccaccccagtagctcggataacaggcacgtgccaccatgcccagctaacttttgcattttagtagagacggggcttcaccatgttggccaggctggtctcgaactcctggtctcaagcgacctgcgcgcctcggcctcccaaagtgctgggattacaggcgtgagccactgcacccggccaccatgctctacttttaattcactgaatactctttttaaaaagataatttgggcctggtgtggtggctcatgcctgtaatcccaacactttgggagaccgaggcgggtggatcaccagaagtcaggagtttgagaccagcctggccaacatggtgaaaccctctctctataagaaatttaaaaaaaaaaaaaaattagccgggtgtcgtagctggcgcctgtaatcccagctacttgggaggctgaggcaggaagaattgtttgaacccggaagccagaggttacagtgagctgaggtcgtgccactgcactccagcctggctgacagagcgagaccccatctcagaaaaaaaaaaaataataataaaataacaagatagtttggggtcttcagagagaagggggtttctgtcgatttttgtgccccaattctcctgaagacaccctcacaaggatctgatgcaggtactattaggacattttccagatgagaaaacagaggctttaaggggcaagggccctctcaagatgagccagcagatgggaggggcctgcagggggtctgtgtccacctgactgtgaagcgtggcctgggccctacatgcttcagggacggggttggggaaagtgagagcactctggggatgggacaagcacagtgtcatggggagcagtccttggggacagagaggcccagtcccccagatctggatgtgaaactgctctggggcctgggatgcactctgtacttcaaaatcagttttcgttgtaattatgcagtagtacctgaacacgtgctcaggaaaaacctgcaaacaatacagaagtctatgagtgacaaagggcgtttccccacggtccccagagggagtctctgttttcccttgggagcctttcttcactgcctggttctgtgcctttgccccctcgtgtaggtgtacacacaaacagcttttcccgtgttccaggaatggggtcagcagtggagatggctctgctggctgggttgggcctgcagggcttcgagtcagctctcttggctccattttgtctcatgacagcgccaggaccaccccttgtggttatttcctttcccttctcctgtatttaaaagcccccacaaacaagtacaatgctacagagtacctcttgctggggccaggggaaaggatgcagtgccgtgggcctcggttcattgggagagggcagagtggccacggaatcagcacaaagtcctggcgagtccagagcagtgtgacccagaggcagaggcctgggagtccccagatcccgttcctccccgaacccacaccaggggagggcaggtcacgcccttccatgaagcagtcacaaatccttgcctgggtcttcatgggctggagctgcctgtcatccagcccgccactccatgcacacgtgcgcacacacgcgcgctcctgcactccacagggtctggccagggcaccccagccactctcagcatggccccgggatagaggacatgggccctccatgtgagactagagggcagaccacagccctttagccacagggagcaaagcccccacctcttgggggccaggtgtgtgaagtagagggaggctgtaaggccagggtaggcaagggggagaggaacgggggcccccagggccaacctcccaggccttattcagggtaccacgcaggaaggcccttgtgaacgcagaggccgacccctgcgcggatgcctccccgtcactcgccactcactcacttagcacctaccaggcaccaggagctgttttgggttctggggaaatagcagggaagcagagaggaaacccaaatgggacacaacgtagtgggtggggaggtaaggagtgctggggagaaaaagtcagaagggcagggtgctcgagggttatgggtgcaatttcaaacaggggagtcagagaaggcctggtggatggtgacctcggaacagaggacagggtggagcgatccccaaggatgtctgggggaagcagagaaggcccagtgaccaggaaaagggctgtgcgcaaagcatctccctacccggccgtctcctccctcagccctgtgtggggctagcacgactggtcccactttacaaagagggaaagcaggctagagtaaaggggcccgccaggcagcccctgagcctgccacactacacacatcagtggggtcctcttcccgtgtgcggacagcggcagggagagggggtgggggtgggggtgaggcccaggggtctgtgtcctcacagggaggctggccaagcatattggaggaggagggctgggggaccccttgggcctggccagctcgcaggggccccaagttcggctggcataccctttgatggaagagggcggtccagggaaggctgcctcctgtgcaggtccggggctctgggaagtacctacccactctccccagggagctgccctcagcagcccccagtccacagcatcccatactcaggtgggacccgcagacttagggtacacagcctggcagcccaccccactgtctccctcagcccccaagtgtgagacattctttcacagagactctctgcctgtgtccttctgaccccagggtacactggaggggaggggctaagccaacagaaccttccagaaaacgtccctttgtgctcgagccctgccagcaggcctggcccagcacccctgatgcgtgtgggttgggggcaactgtaacagggccttgtctcaagaaccccacggctctcctcgcccaccagcctgccagcccgtaccgagccactgtctgtagagggtggaagggctggcatggagtcaggctcttcagtttctctccaagcctcacaagacctgaaaaggggggcaggcagtggggcttggagagggaagtgggctgccccaagtcacactgcagatcagccacagaccccaagtcggtgggactcggaggctgctcctgttcccactgcaccacttcccctctgcagctgggctgctcctgcctctgctcaccgggggtgcaggagacacggggcccaggctgcagagcccctccttgctaggaaggtcctgcctccttggtagggatgggaaacaccatcagattgaggccaggacactcgggcctggaccactggccatggagaacgtgaactccctggggtcccaaggactgctcacagccaggtggaatgagggggacaaatgagtgtgtgactccgagtaagctctactcctctaagagtggggcccaaacaccaccttccttccagcttataagagcacggacggggcagcttccaggcccagctgaagaggcgccgcttccagtagccttcgcccccccattcccagcctgtaggcctagggggttcttgcccgccttcaacatcctgcaatgaccacgtcatgaccatggccaccctgaggcatctgacatttgtttaaagctttatgttcaaaataatgggcttgaggccagcaatttgagaccagcctgggcagcatagcaagaccccatctctaaataaatacataaaatagtggcttcttcattgccagtcctcaactagctaggaagaaaggcatcggttagcctggcgccacgctacagctgaggaactgaggcttgccgagggtgagtgacctgcctgaggtcacgccaccaagcaagcagccaagcccagcctctcccatctccctccaccttacctcagtaccaagccccaattccggcacacactgatcttccattacttccctcagccaaactgtctcctggacaatgtcactgggtctccagatggcgtgaagcaaccccactctctggccacccatcccccgccttccagggacagcaggtctgagggcacctgcctgccatttaagtgtggctcagctctgctgtgaggcaggggcaggccagcccccaactctagaggggaggcctcctggttccagggcccctgccaagctcagctgggagctggcggcagtgacagcactgtgttccccagtgcttggaaggttcccagactcttggctggagaatgcgatgccacttctcttgttaaatggtaccaggtggcaaggaaaatgtggcacagggacctgagagaggtgccccatgcgggcatgggggggagggggtgtgggggaaggcctctcctcctggtcgccagcaaaaagtgacatcccagatcaggcaggctgcatccacaccgccttcctcccctgcttggacacccattccatcagccccgccaaagacctactctaccctccagttaccctgcaaagacacgcattctggccaaggacagaagggccaaagacaaggtcactctctgggaaggctggccttccgggctctgctgctactgcccatcccttcagggaccaaagtgaaggttcacctccagcctcttccttctgccctggagcctcccctcctcaagcagaggctggcttccccgaccaagtgcccgaggggctttttgctgcgggcgaaggcctgctcaggcccagagcctgcaccactctgctcccacgctaagggcctctgccctcgggcctatcctgccaccccctgccctctcgcgatgctgtgttctagtggtcccatcctgaggcaggaaccatggcttgcagactgctgctttctggagcacacgggctgtctccaccttctgtattccagctcagggcctggccagtggagatgcccaaatcttttttttttttttttgagatggagtctctctgtcacccaggctggagtgcagtggtgcaatctcagctcactgcaacctctgcctcctggtttcaagtgattctcctgcctcagcctcccaagtagctgggattacaggcgcatggcaccatgctcggctaattttgtatttttagtaaaggcggggtttcaccgtgttactcaggctggtctcgaactcctgacctcaagtgatctgcccaccgtggcctcccaaagtgttgggattacaggcgtgagccactgcgcctggcctccaaacctttcttcaaggattaggcaggcacacagaaaaactggagagaagcagagtggggctggctctgctgccagttagctgtgtgactgtgacacacctcccatgacaacggtctgtttcatgaactgtgaattggggaaacatcatctacctcacaggtctgctgtgtgagaagagctctgtgaagcatgacgtgcctgcaaatgtcgggtgacatgtggggcctcgaccggaatctacgtggctgaagtcctcagcggagcccaagggactgccaggaagtcagccaggtgtctacaaacccttactgagcactaggggtggggcctgagctaagttccagaaggaacctacagaaaggggcagatagggccgcatccccgacacctacaaggagttagaaggcggcccacccctcagtgaagggcatgggcccagctgcgatggtgacatcaaagcagagaggccttaggccggccgcggtgactctcacacctgtaatcccagcactttgggaggccaagggtggcagatcacgtgaggtcaggagtttgagaccagcctggccaacatggcgaaacctgtgtctactaaaaatacaaaaattagctgggcatggtggcgtgcacctgtaatctcagctgctcgggaggctgaggcaggagaatcacttgaaccagggagcagaggctgcagtgagttgagatcacgccactgcactccagcctgggcgacagagcaagactccacaccccaccaaccaaaaaaaaagaaaaaagcagacaggccccgaggtgctggtgcagtgctgcccagggcttcaactggggtccatcctgaggcctgaggctggtgggcatgccctggcacatgcagggtgaatgtggggagggcactgtcatgttccaagggagtcaggacctggctctctatgggatttctagagtccacttctgatgcctctacaatctccaattagacccaagggagaaggaaagcaactggcactgtacaatctctcgccatcaaccccaaaatgagacctccagccagcttttctcacttcttgcaaacttctgacagtggtgtaattcctaatttgcaccagtttttgaactccgctgtgtgatttcttttttggagatagagtctcgctccgctgcctgggctgaagtgcagtggtacgatctcagctcactgcaacctccgcctcctgggttcaagcaattttcctgcctcagcctcccaagtagctgggactataggcacagactgccatgcccggctaattttctgtattttagtggagacggggtttcaccgtgttgccaggccagccacaaactcctgagctcaggcaatccgcccgcctcggctttccatgtgatttcaaatagttactgttcactgagtgcctacctagcaaggtgcaaggcattaacacatgttatgaacacagcaacctactcgcaggcatggggggtcacacagtcccaggcatgtccatcgtctcattcaatcctcccaacgtgacaaggtgagcagaacctcatctccattcacatctgagaaaacaagctccaagaggcaacaaccaggttctataatagcagggccaggatgtggagtctgactggcataacgagtccaagctccccttaccccgccccactcctttttttttctttgagacagagtctcgctctgtcgcccaggctggagtgcagtggcgcgatctcagcttactgcaagctccgcctcccaggttcatgccggtcttctgcctcagcctcccaagtagctaggactacagatgcccgccaccatgcctggctaatttgtttgtatttttagtagaggcagagtttcactgttagccaggatggtctcgatctcctgaccttgtgatctgcccgcctcggcctcccaaagtgctggaattataggtgggaaccaccgcgcccagcattttttttttttttttttgagacggagtctcgctctgttgcccaggctggagtgcagtggtgtaatctcggttcaacaccacctccgcctcccaggttcaagtgattctcctgcttcagcctcccgagtagttgagactacaggcctgcatcaccatgcctggctaatttttgtatttttagtagagacagggtttcactatgttggccaggctggtctcgcttttttttttttttttttttgaggtggagtctcactgtgttgcccaggctggagtgcagtggcacagtctcagctcactgcaacctccgcctcccgggttcaagtgattctcctgcctcagcctcctgagtagctgggactacaggcgcccaccaccacatctggctaatttttgtatttttgtagagacagggatacaccatgttggccaggatggtctcgaattcctgacttcaagtgatccacccacctcggcctcccaaagtgctgggattacaggcgtgagcctctgcacctggcccaccctgccctactcttaattgttctgagtcagtttcctcatctacaaagtcaaagtggtgaatgagaccagtgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcctgcctacttccttcaggtctttatttatttagaagtcctgtttgcaggggcgttccctggttaccctgcctaactcttgcctgtttaccaccacctgacacgccacgcctccactttccagcacgtcatttaccccatttgtttccttgactagaacaaagctggggctttttttgttttgttttgagacagagtctcgctttgtcacccaggctggagtgcagtggcaccatcttggctcactgcaatctctgcctcccaggttcaagcgattcttgtgcttcagccccctgagtagctgggattacaggtgtgtgccaccatgcccagctaatttctgtatttttagtaaagactgggtttcaccatgttggccaggctggtctcaaactcctgacctcaggtgatccttccacctcggcctccctaggattacaggtgtgagctaccgtgcccagcaggaagctggggtttttgactcttttgttctgtgctgtgtccctggagcctagaacagtggtcggtaccacagaaactcaggaagtatttttttaataagtcctctaagtttggtggcctttgttcctgaaatctatctctaggctgctgaggcttgggttccacaacctgcctcctgcagcagcctcgacccagcctcctgcctctggccaggcttcctccaatccacatcactccagagacgtgacccaaatgcccaggtctgaccacaatcatgactttgctcatgacatccaagaagaaatgacctaattctaccaccaggctcccagagctcagcaaatccttctgctgttgcttatgttacatgtctgcttatttcatgagattctgagagggcagggccaatatctgactcatttgtgttcccagggcccagcacagagccctaccagcagacctaggcaattatttcactgggccaatcacataccttcctgtgtttcctcatcaatggaacggggccggtaattcctgccacgcaaaggcctcaagatatatggtggggcttaaactcaattatgcagaagagtgttctgaagaggacaacaccagcatgaagaaggaggccagttcaaaccctgggtgctccatctgagggatgcaggcctatgtcctgagcaggcatttctgcagctcctgctgcggcgggaaccaggctgggacctcctgcttcctgcccaggccaagagagaacccaggacctggcctggcctgccacctcatggccacagacagaattacaccacttgtcacagggtgagtaggcaccactgtcccccaccagcacctgaactatggagcaaagatcgtgactcccctttagagatgcttcgtggcagacaaagtgacctattcaaagtcacacggtcagcaggctaggacagcagaacagctggctctacccctcactcacgagctgtctgaccctgagcaagtcgcctgttctctctgggaggaaagcctggcggggcaggcacttcaggtgtgcccaggcctcagggtcccatctgtgagatcagagtgctgatctggtcaggggctcaaaaagtagtcatcaactaggaaatcaaatgcgtgatagagtcaagtgtgtatcatgatcgatgcatcgagcaaggggcaggcctaatggctgctgccacatgagacagtgatgagacctgcccaatcctaatgtgatatgaaaacatccccatttctactggcgacagccacagactgctatcctctgaattctgcccttagaccagaggagtgccctgacaccaggataagggaccctggtctagacagtggtgatggattggtggtcacagatcatgtgctgactcggttctccctgcatttcatcactttgctttcggtaacaggcacaagacccagaacagagcagaaacacaactcttcgaaatgtatctcaaaaccaataaacaggtttccaaaggaatggagcaggcctggcacatgggtgtggcagtgcgggccctgggacccctcagtagacccatcgcggggagcacatcaactcctgctgaggcctctttagcaaaaagtcatcaggatttatcctgcataaaaagcggctaaaggccaggctccgtggctcgctcctgtaatcccagcactttgggaggctaaagtgggaggatcgcttgaggccaggagttcaaaaccagtgtggggaacacagcaagacctcatcgctatattaaaaagtaaataaacagtggccgggtgcagtggctcatgcctgtaatcccagcactttgggaagccgaggcgggcggatcacgaggtcaggagattgagaccatcctggctaacacggtgaaaccccgtctctactaaaaaatacaaaaaattagctgggcgtggtggtgggtgccggtagtcccagctacttgggaggctgaggcaggagaatggcgtgaactcgggaggcagagcttgcagtgagccgagatcgcgccactgcattccagcctggacaacagagcaagactccatctcaaaaaaaaaaaaaaagtaaataaataaataaatacttagctaggtgcggtggtgcatgcttgtagtcctagttactcagtaggctgaggtgggaggttcacttgagcccaggagctcaagtctgcagtgagccatgagtacaccactgcaatccagcctgggcaacagagcaagaccttatctaaaacaataacgacaacaacaacaacaacaaaaaggctactttcctacccctcgtggttagtttcaccttgtgagaaacaccaacaggatccagttggggcagaattccctacatatgcatccaaccatctacccacctacccaacaaacatccctattgcctgctgggtaccctagcttggggtgggacgagacaagatctgaaatcagagagttaaggggaaatcaggcattctgactcccagaggacacaaggatgcaccagttaaagagacggacatacgcttggcctcacaatcacttacaccccagcaggagagtggactcacaaatacatacacataagacttagttataactgagtatgcagaaactcagcaaaagcaaaagcagggcagcacgtgctagagcctggcatataagatgcactccagatgaaagcacatcatcctcacttcacacctgtgtaccccaaggctcagggtgacctgcccaggtcatagccagtgagtagaaaagccactcaaaccaggatcctgtgtctccctccccttcaggagctgcctcgctcggatactaagtccttcgataagcattcccaatgtgcccactgtgtgctgaccaccctttccccgcacccgagtatagtgttggtctctgtgatcagcatgctcacctccaggtcacagtagagcagggggctttgataggtgtgggccagcttcaccacggtgtgccggtgaatgctgcagtggctctcccgcccagctggaaagaagccatgagtgctatagctgcaatctctaccttcctggctggaattcaggaagtgctgggcagagtcactcacttccccactctggggctcagtttctttctagtcgcgagggtgacagtcctattctactttcttttctaggtagtcaagaatatcaaattagacaatgaagataataatagctcctaccccactgagtcactctagagtcagtgagttgacatctagaaattacttggcctgcatttgctcaccaatgcttcttgagaattatctgtgccaggcactctgctcaaggagctaacagttcagctgggaaggcagacaggtcagacacctcatgcatgccggagtgacactggggctgagttttgaggtatttgtaggggttagcaagacaaagaagaggaaatgtatttgacagaagcctagagtaaacaaaaagaggacggccgggtgcggtggctcaggcctgtaatcccagcactatctgaggcaggcggatacctgaggtcaggagttcaagaccagcctggccaacatggtgaaaccccatctctactaaaatacaaaaattagctgggcatgatggcgggtgcctgtaatcccagctactcgggaggctgagatgggagaattgcttgaaccagggagacggtggttgcggtgagctgagatcacgccatagcactccagcctgggcggctgagcgagactccgtctcaaaaaaaaaaaaaaaaaaaagggacgggccctgtaacaggacttacctaggtgtaaaccttggctctaccacttttcatctaggggcctggggcaacttaacctcatgactgtaaaacagaggtaataacacctacctccaataggaatatgaaaacaaagcaattaccgtgtctgcctcacagtgacagctcaaaagatgtcagccattattattttcactgttaatattacaaagtctcaggaacagcaggactttttcagagaacgataagctgacccagagaaggagagtcaccggagatgagactagctcagaaggcagaggccaaactgcaaagtgttttatgtctttagagtttggattttaccgaaagccacaggcaaccactaggcaactccaagtaatggcagagttatctgctcatattcactcttagaaaggctgacaacaggtcagattccaaagtatgtgtatatgtgttctttcggtttttaaatttaacttttattttaagttcaggggtacatgtgcagatttgttatgtagttaaaacttgtgtcatggggtttgttgtacagatcattgtcacccaggtattaagcctagtacccattagttatttttccagatcttctccttcttcctgccctccaccctccgataggccccagtgtgtgtaaaatacatgctctttccatcacccagggtgcctcagcaagaagcctacggccgccccagctttcccttggctgggggtgggcagtaacaggcgaggaacgtacttaccacctgtggcgaggaaacacaccttccccaagaagaagctggcatccacatggcgcagggactcctctgtgttctggagactggggtggccaggccagggtgagaaaacaaaccagagaacaaaactttacaacggagaaagcagaagtccttgcttctctgatcctagaggccagagaatgacaagagggtgactttctctggagaaatatttgtcctttaattttttttttttttttttttttagatggagtttcactttgttgcccaggctggagtgcagtagcgcgatcttggctcactgcaacctctgcctcctgggttcaaatgattctcctgcctcagcctcccgagtagctgggactacaggtacatgccaccacgcctggctaatttttgtattttagtagagacggggtttcaccatgttgcccaggctggtctcgggcaatctgcccaccttggcctcccaaagtgctgggattacaggtgtgagccattgtgcccggccgttgtgtattttaaacattgtgcactgaccactggctcctctctcctcaccttacagattgacctcagccagcctctcccatcctcaccacttcccatcacaagttaggtcaccgtctcagcacagtcctgagccaggcctgcctgagccctgactgccccttcctctggctctcacctgtatttgctgtgaagattaaccacaaacacgatcaggtcaattcggggccgattcacactggagggcaaagggagggactttgccaagtggctgaaaaacaggaaattgcaggactcaagatatccgtacccccctcatagcgaccgtttaaatgctgcccttcatgtggaaagaggccgtcaagggctccccacctcatcctagccacccgaggctcttgtggccacgactccttgggccagcacagaggcaggacaggtccggtcctattcagattactcctgtctgattccctctgccagaaacgggctctgtttagtcaccacctcggcaaggggaggttgggatataagacggcatgggactagccagctacgctgcatgctgggagaaggaccagcctcagaggagggggcgctgggcttcggagtttagcagctaggaccgaatccctctggagtgagagacacgtgggcccaggccacagccgcggctacttacaccttcagctcggaggcgcagtcctctttgagcatcgagtccgccagctgctgcagaagagcatcctccgtgcccaccagctgcgcagggagagagagcggacagtcgagccctaggcacagcaccccctggggagggcctggcccttcgacccactcccggggggatcgggacaccgccagcaggcggctcggaggacatttcccgagaagtggaccccgcgaagcggcacgggctgggggcctgaggtttggacccgctgcaggcctgtgggcaccgcactctctactacccgaccctcgctcccaccgccggcctctccaggaggccagacccccagacgcgggaaaaccaattccaggcgcgggaactcgccaatcagaagctgggaaagggtccgccgagcacctattggtgggtgcgtccctcaacctcagagagcggctactccaattggttcagagcatggctctccgcctattccccgcccccgccacggtagcgcgcgctggcttggcgcctcagagagctcagttgacctagtggctgaagcaccgcccaggaggaaaaaccggcgggggaagcagggccgcctgcacctaccaagatggtggccgtgttcaggccgggcagcttgtccaggggcctcaacaccgacatcacagccgcaggaccaaccgttgctcctgcggtgcgcgccgatctttcaaaccgccctgagtccagcccctagagcgcggcctgggggcacgtgcctccttataggcggggcttcgcgggacgggacggggcctcttaaaggaaccgaacctttatctccttttctgaggggcgttccagcgctacccgtggaacacgtggtggacaggcctttggttccacgctccacagtaagcaggtttttagtgattcctttgttcactttcattcattcatgctcatacacagtactttttttttttttttttgagacagagtctcgctttgtggcccaggctggagtgcaatgcgcgcaatctcggctcactgcaacttctgcctcccgagtttaagcgattctcctgcctcagcctcccaaggagctgggactacgggcgcgcgtcaccacgcccgacttatttttttatttttagtagagacggggtttctccaagttgcccaggccggtctcaaactcctggcctcaagtgatcccgcctcggcctcccaaagtgagtgctgagattacagacgtgagccaccgtgcctggccctttttttttttttttttttggagcgtcactttgttgcccaggctggactatagtgacacgatcatagctcactacagcttcaaactcctgggctcaagtcatcttcctggcttagcctcctgagtagctggaactacaggcaagtgccaccatggggatctggccatgttgcccaggtgggtcgtaaactcctggcctcaagcagccctcctgcttcagcctcctgagtagctgggactaccgctgcacaccagcaggccctgccaattgactgcttttacagtgagtggtaagcatgctgttctttgtccaatgggagactttacctcatctttcaaggttccttgctgcaaacacagcctgagtacagagctgtcagggtcttgctttcttgacatacccagcaagaacatgcagggacgctcagggcccatagcaaactggttctgccaacagttatataataacttgttcactgtctctacatctaaaatgtaagaaacaagaggttagagactttgtcactttgtatgtccagcactctaaaagtccctggtacatcgtagttaataaatatttgttgagtgaatggatggattacattcatccattcattctcagcagtcattcattcatcatttcctatgcccagacccaatgccctaccctaggaagtcagttgaatcagacattattgattaacttagtttgatgggggtgggatagacaatgataacagtgtgttcattgttgtaataactgggagagcagagacactgtctagcctaaatccttcttactgcagactaaactaactgtgtcttgctcagaaagatcaggacgtaaatggccccatagagccactgccctcagcacagatacggctttcattcctcatggcatggggtgtggagaggacttcctgaaagtcaagcagtagtaggcactatgacaagaaaataaagtaagctgaacgccgtggctcatgcctataacccagcactttgggagaccgaggcgggtgaatcacttgaggccgggagtttgaggccagcctaggcaatatagtgagacctcatctctacaaaaaaatttttaaattagctgagcagggtgggcatggtggttcacgcatgtaatcccagcattttgggaggccgaggcgggcggatcacctgacatcaggagtttgagaccagcctgaccagcatggagaaaccctgtctgtactactaaaaatacaaaattagctgggcgtggtggtgcatgcctgtaatcccagctacttgggaggctgtggtaggagaatcgcttgaacttgggaggcagaggttgcagtgagctgagattatgccagtgtactctggcctgggcaacaagagcgaaactccatcacaaaaacaaaaaacaaacaaacaaattagccaggtatggtggcggtggcgggcgcctgtaataccacctactcgggaggctgaggcaggagaatcacttgaacctgggaggcggaggttgcagtgagctgagatcgcaccactgcactccagcctgggtgacatgtgagactccatctcaaaaaaaaaaaaatgaaagataaactaaagctgtctggcagaagagatggatgggaggaggctactttagagcagggaggcctccctaaggtgacatttgagcagatgcttgaattcagtgagagaggggccccttaagtatgatgaagaagaggcctcaggcagaaggcagtgcaagtggaaagcccctgagtgggaagcactcctggcacttccgaggcgtagcaaggaggccagtggctgtggcagatggagtaagaagaacaggggaggaggtgaggccacggaggtgattgagctcccagagactgaggcccttagagagtggtgggctgggaaaagactttggactctggtggggactttccaggaggggccgggctgagacccattgggtcagcatgtgctgagtgcctgccctggggaccctggtcccagaggggccaaactgcttcagggagttaccacttgtaacaagagacaaggcactgcagttggggaggccatcggggagcagccaggagcagcaggaacccaggggaagctgctctgtgtccctggggagcctgcactccacttcaccggggcggtgatc

SEQ ID NO: 161 - DNA, 12234 bp, Homo sapiens
  source 1..12234: mol_type = genomic DNA
aagtgtgagacattctttcacagagactctctgcctgtgtccttctgaccccagggtacactggaggggaggggctaagccaacagaaccttccagaaaacgtccctttgtgctcgagccctgccagcaggcctggcccagcacccctgatgcgtgtgggttgggggcaactgtaacagggccttgtctcaagaaccccacggctctcctcgcccaccagcctgccagcccgtaccgagccactgtctgtagagggtggaagggctggcatggagtcaggctcttcagtttctctccaagcctcacaagacctgaaaaggggggcaggcagtggggcttggagagggaagtgggctgccccaagtcacactgcagatcagccacagaccccaagtcggtgggactcggaggctgctcctgttcccactgcaccacttcccctctgcagctgggctgctcctgcctctgctcaccgggggtgcaggagacacggggcccaggctgcagagcccctccttgctaggaaggtcctgcctccttggtagggatgggaaacaccatcagattgaggccaggacactcgggcctggaccactggccatggagaacgtgaactccctggggtcccaaggactgctcacagccaggtggaatgagggggacaaatgagtgtgtgactccgagtaagctctactcctctaagagtggggcccaaacaccaccttccttccagcttataagagcacggacggggcagcttccaggcccagctgaagaggcgccgcttccagtagccttcgcccccccattcccagcctgtaggcctagggggttcttgcccgccttcaacatcctgcaatgaccacgtcatgaccatggccaccctgaggcatctgacatttgtttaaagctttatgttcaaaataatgggcttgaggccagcaatttgagaccagcctgggcagcatagcaagaccccatctctaaataaatacataaaatagtggcttcttcattgccagtcctcaactagctaggaagaaaggcatcggttagcctggcgccacgctacagctgaggaactgaggcttgccgagggtgagtgacctgcctgaggtcacgccaccaagcaagcagccaagcccagcctctcccatctccctccaccttacctcagtaccaagccccaattccggcacacactgatcttccattacttccctcagccaaactgtctcctggacaatgtcactgggtctccagatggcgtgaagcaaccccactctctggccacccatcccccgccttccagggacagcaggtctgagggcacctgcctgccatttaagtgtggctcagctctgctgtgaggcaggggcaggccagcccccaactctagaggggaggcctcctggttccagggcccctgccaagctcagctgggagctggcggcagtgacagcactgtgttccccagtgcttggaaggttcccagactcttggctggagaatgcgatgccacttctcttgttaaatggtaccaggtggcaaggaaaatgtggcacagggacctgagagaggtgccccatgcgggcatgggggggagggggtgtgggggaaggcctctcctcctggtcgccagcaaaaagtgacatcccagatcaggcaggctgcatccacaccgccttcctcccctgcttggacacccattccatcagccccgccaaagacctactctaccctccagttaccctgcaaagacacgcattctggccaaggacagaagggccaaagacaaggtcactctctgggaaggctggccttccgggctctgctgctactgcccatcccttcagggaccaaagtgaaggttcacctccagcctcttccttctgccctggagcctcccctcctcaagcagaggctggcttccccgaccaagtgcccgaggggctttttgctgcgggcgaaggcctgctcaggcccagagcctgcaccactctgctcccacgctaagggcctctgccctcgggcctatcctgccaccccctgccctctcgcgatgctgtgttctagtggtcccatcctgaggcaggaaccatggcttgcagactgctgctttctggagcacacgggctgtctccaccttctgtattccagctcagggcctggccagtggagatgcccaaatcttttttttttttttttgagatggagtctctctgtcacccaggctggagtgcagtggtgcaatctcagctcactgcaacctctgcctcctggtttcaagtgattctcctgcctcagcctcccaagtagctgggattacaggcgcatggcaccatgctcggctaattttgtatttttagtaaaggcggggtttcaccgtgttactcaggctggtctcgaactcctgacctcaagtgatctgcccaccgtggcctcccaaagtgttgggattacaggcgtgagccactgcgcctggcctccaaacctttcttcaaggattaggcaggcacacagaaaaactggagagaagcagagtggggctggctctgctgccagttagctgtgtgactgtgacacacctcccatgacaacggtctgtttcatgaactgtgaattggggaaacatcatctacctcacaggtctgctgtgtgagaagagctctgtgaagcatgacgtgcctgcaaatgtcgggtgacatgtggggcctcgaccggaatctacgtggctgaagtcctcagcggagcccaagggactgccaggaagtcagccaggtgtctacaaacccttactgagcactaggggtggggcctgagctaagttccagaaggaacctacagaaaggggcagatagggccgcatccccgacacctacaaggagttagaaggcggcccacccctcagtgaagggcatgggcccagctgcgatggtgacatcaaagcagagaggccttaggccggccgcggtgactctcacacctgtaatcccagcactttgggaggccaagggtggcagatcacgtgaggtcaggagtttgagaccagcctggccaacatggcgaaacctgtgtctactaaaaatacaaaaattagctgggcatggtggcgtgcacctgtaatctcagctgctcgggaggctgaggcaggagaatcacttgaaccagggagcagaggctgcagtgagttgagatcacgccactgcactccagcctgggcgacagagcaagactccacaccccaccaaccaaaaaaaaagaaaaaagcagacaggccccgaggtgctggtgcagtgctgcccagggcttcaactggggtccatcctgaggcctgaggctggtgggcatgccctggcacatgcagggtgaatgtggggagggcactgtcatgttccaagggagtcaggacctggctctctatgggatttctagagtccacttctgatgcctctacaatctccaattagacccaagggagaaggaaagcaactggcactgtacaatctctcgccatcaaccccaaaatgagacctccagccagcttttctcacttcttgcaaacttctgacagtggtgtaattcctaatttgcaccagtttttgaactccgctgtgtgatttcttttttggagatagagtctcgctccgctgcctgggctgaagtgcagtggtacgatctcagctcactgcaacctccgcctcctgggttcaagcaattttcctgcctcagcctcccaagtagctgggactataggcacagactgccatgcccggctaattttctgtattttagtggagacggggtttcaccgtgttgccaggccagccacaaactcctgagctcaggcaatccgcccgcctcggctttccatgtgatttcaaatagttactgttcactgagtgcctacctagcaaggtgcaaggcattaacacatgttatgaacacagcaacctactcgcaggcatggggggtcacacagtcccaggcatgtccatcgtctcattcaatcctcccaacgtgacaaggtgagcagaacctcatctccattcacatctgagaaaacaagctccaagaggcaacaaccaggttctataatagcagggccaggatgtggagtctgactggcataacgagtccaagctccccttaccccgccccactcctttttttttctttgagacagagtctcgctctgtcgcccaggctggagtgcagtggcgcgatctcagcttactgcaagctccgcctcccaggttcatgccggtcttctgcctcagcctcccaagtagctaggactacagatgcccgccaccatgcctggctaatttgtttgtatttttagtagaggcagagtttcactgttagccaggatggtctcgatctcctgaccttgtgatctgcccgcctcggcctcccaaagtgctggaattataggtgggaaccaccgcgcccagcattttttttttttttttttgagacggagtctcgctctgttgcccaggctggagtgcagtggtgtaatctcggttcaacaccacctccgcctcccaggttcaagtgattctcctgcttcagcctcccgagtagttgagactacaggcctgcatcaccatgcctggctaatttttgtatttttagtagagacagggtttcactatgttggccaggctggtctcgcttttttttttttttttttttgaggtggagtctcactgtgttgcccaggctggagtgcagtggcacagtctcagctcactgcaacctccgcctcccgggttcaagtgattctcctgcctcagcctcctgagtagctgggactacaggcgcccaccaccacatctggctaatttttgtatttttgtagagacagggatacaccatgttggccaggatggtctcgaattcctgacttcaagtgatccacccacctcggcctcccaaagtgctgggattacaggcgtgagcctctgcacctggcccaccctgccctactcttaattgttctgagtcagtttcctcatctacaaagtcaaagtggtgaatgagaccagtgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcctgcctacttccttcaggtctttatttatttagaagtcctgtttgcaggggcgttccctggttaccctgcctaactcttgcctgtttaccaccacctgacacgccacgcctccactttccagcacgtcatttaccccatttgtttccttgactagaacaaagctggggctttttttgttttgttttgagacagagtctcgctttgtcacccaggctggagtgcagtggcaccatcttggctcactgcaatctctgcctcccaggttcaagcgattcttgtgcttcagccccctgagtagctgggattacaggtgtgtgccaccatgcccagctaatttctgtatttttagtaaagactgggtttcaccatgttggccaggctggtctcaaactcctgacctcaggtgatccttccacctcggcctccctaggattacaggtgtgagctaccgtgcccagcaggaagctggggtttttgactcttttgttctgtgctgtgtccctggagcctagaacagtggtcggtaccacagaaactcaggaagtatttttttaataagtcctctaagtttggtggcctttgttcctgaaatctatctctaggctgctgaggcttgggttccacaacctgcctcctgcagcagcctcgacccagcctcctgcctctggccaggcttcctccaatccacatcactccagagacgtgacccaaatgcccaggtctgaccacaatcatgactttgctcatgacatccaagaagaaatgacctaattctaccaccaggctcccagagctcagcaaatccttctgctgttgcttatgttacatgtctgcttatttcatgagattctgagagggcagggccaatatctgactcatttgtgttcccagggcccagcacagagccctaccagcagacctaggcaattatttcactgggccaatcacataccttcctgtgtttcctcatcaatggaacggggccggtaattcctgccacgcaaaggcctcaagatatatggtggggcttaaactcaattatgcagaagagtgttctgaagaggacaacaccagcatgaagaaggaggccagttcaaaccctgggtgctccatctgagggatgcaggcctatgtcctgagcaggcatttctgcagctcctgctgcggcgggaaccaggctgggacctcctgcttcctgcccaggccaagagagaacccaggacctggcctggcctgccacctcatggccacagacagaattacaccacttgtcacagggtgagtaggcaccactgtcccccaccagcacctgaactatggagcaaagatcgtgactcccctttagagatgcttcgtggcagacaaagtgacctattcaaagtcacacggtcagcaggctaggacagcagaacagctggctctacccctcactcacgagctgtctgaccctgagcaagtcgcctgttctctctgggaggaaagcctggcggggcaggcacttcaggtgtgcccaggcctcagggtcccatctgtgagatcagagtgctgatctggtcaggggctcaaaaagtagtcatcaactaggaaatcaaatgcgtgatagagtcaagtgtgtatcatgatcgatgcatcgagcaaggggcaggcctaatggctgctgccacatgagacagtgatgagacctgcccaatcctaatgtgatatgaaaacatccccatttctactggcgacagccacagactgctatcctctgaattctgcccttagaccagaggagtgccctgacaccaggataagggaccctggtctagacagtggtgatggattggtggtcacagatcatgtgctgactcggttctccctgcatttcatcactttgctttcggtaacaggcacaagacccagaacagagcagaaacacaactcttcgaaatgtatctcaaaaccaataaacaggtttccaaaggaatggagcaggcctggcacatgggtgtggcagtgcgggccctgggacccctcagtagacccatcgcggggagcacatcaactcctgctgaggcctctttagcaaaaagtcatcaggatttatcctgcataaaaagcggctaaaggccaggctccgtggctcgctcctgtaatcccagcactttgggaggctaaagtgggaggatcgcttgaggccaggagttcaaaaccagtgtggggaacacagcaagacctcatcgctatattaaaaagtaaataaacagtggccgggtgcagtggctcatgcctgtaatcccagcactttgggaagccgaggcgggcggatcacgaggtcaggagattgagaccatcctggctaacacggtgaaaccccgtctctactaaaaaatacaaaaaattagctgggcgtggtggtgggtgccggtagtcccagctacttgggaggctgaggcaggagaatggcgtgaactcgggaggcagagcttgcagtgagccgagatcgcgccactgcattccagcctggacaacagagcaagactccatctcaaaaaaaaaaaaaaagtaaataaataaataaatacttagctaggtgcggtggtgcatgcttgtagtcctagttactcagtaggctgaggtgggaggttcacttgagcccaggagctcaagtctgcagtgagccatgagtacaccactgcaatccagcctgggcaacagagcaagaccttatctaaaacaataacgacaacaacaacaacaacaaaaaggctactttcctacccctcgtggttagtttcaccttgtgagaaacaccaacaggatccagttggggcagaattccctacatatgcatccaaccatctacccacctacccaacaaacatccctattgcctgctgggtaccctagcttggggtgggacgagacaagatctgaaatcagagagttaaggggaaatcaggcattctgactcccagaggacacaaggatgcaccagttaaagagacggacatacgcttggcctcacaatcacttacaccccagcaggagagtggactcacaaatacatacacataagacttagttataactgagtatgcagaaactcagcaaaagcaaaagcagggcagcacgtgctagagcctggcatataagatgcactccagatgaaagcacatcatcctcacttcacacctgtgtaccccaaggctcagggtgacctgcccaggtcatagccagtgagtagaaaagccactcaaaccaggatcctgtgtctccctccccttcaggagctgcctcgctcggatactaagtccttcgataagcattcccaatgtgcccactgtgtgctgaccaccctttccccgcacccgagtatagtgttggtctctgtgatcagcatgctcacctccaggtcacagtagagcagggggctttgataggtgtgggccagcttcaccacggtgtgccggtgaatgctgcagtggctctcccgcccagctggaaagaagccatgagtgctatagctgcaatctctaccttcctggctggaattcaggaagtgctgggcagagtcactcacttccccactctggggctcagtttctttctagtcgcgagggtgacagtcctattctactttcttttctaggtagtcaagaatatcaaattagacaatgaagataataatagctcctaccccactgagtcactctagagtcagtgagttgacatctagaaattacttggcctgcatttgctcaccaatgcttcttgagaattatctgtgccaggcactctgctcaaggagctaacagttcagctgggaaggcagacaggtcagacacctcatgcatgccggagtgacactggggctgagttttgaggtatttgtaggggttagcaagacaaagaagaggaaatgtatttgacagaagcctagagtaaacaaaaagaggacggccgggtgcggtggctcaggcctgtaatcccagcactatctgaggcaggcggatacctgaggtcaggagttcaagaccagcctggccaacatggtgaaaccccatctctactaaaatacaaaaattagctgggcatgatggcgggtgcctgtaatcccagctactcgggaggctgagatgggagaattgcttgaaccagggagacggtggttgcggtgagctgagatcacgccatagcactccagcctgggcggctgagcgagactccgtctcaaaaaaaaaaaaaaaaaaaagggacgggccctgtaacaggacttacctaggtgtaaaccttggctctaccacttttcatctaggggcctggggcaacttaacctcatgactgtaaaacagaggtaataacacctacctccaataggaatatgaaaacaaagcaattaccgtgtctgcctcacagtgacagctcaaaagatgtcagccattattattttcactgttaatattacaaagtctcaggaacagcaggactttttcagagaacgataagctgacccagagaaggagagtcaccggagatgagactagctcagaaggcagaggccaaactgcaaagtgttttatgtctttagagtttggattttaccgaaagccacaggcaaccactaggcaactccaagtaatggcagagttatctgctcatattcactcttagaaaggctgacaacaggtcagattccaaagtatgtgtatatgtgttctttcggtttttaaatttaacttttattttaagttcaggggtacatgtgcagatttgttatgtagttaaaacttgtgtcatggggtttgttgtacagatcattgtcacccaggtattaagcctagtacccattagttatttttccagatcttctccttcttcctgccctccaccctccgataggccccagtgtgtgtaaaatacatgctctttccatcacccagggtgcctcagcaagaagcctacggccgccccagctttcccttggctgggggtgggcagtaacaggcgaggaacgtacttaccacctgtggcgaggaaacacaccttccccaagaagaagctggcatccacatggcgcagggactcctctgtgttctggagactggggtggccaggccagggtgagaaaacaaaccagagaacaaaactttacaacggagaaagcagaagtccttgcttctctgatcctagaggccagagaatgacaagagggtgactttctctggagaaatatttgtcctttaattttttttttttttttttttttagatggagtttcactttgttgcccaggctggagtgcagtagcgcgatcttggctcactgcaacctctgcctcctgggttcaaatgattctcctgcctcagcctcccgagtagctgggactacaggtacatgccaccacgcctggctaatttttgtattttagtagagacggggtttcaccatgttgcccaggctggtctcgggcaatctgcccaccttggcctcccaaagtgctgggattacaggtgtgagccattgtgcccggccgttgtgtattttaaacattgtgcactgaccactggctcctctctcctcaccttacagattgacctcagccagcctctcccatcctcaccacttcccatcacaagttaggtcaccgtctcagcacagtcctgagccaggcctgcctgagccctgactgccccttcctctggctctcacctgt

SEQ ID NO: 162 - DNA, 5030 bp, Homo sapiens
  source 1..5030: mol_type = genomic DNA
tctctatgggatttctagagtccacttctgatgcctctacaatctccaattagacccaagggagaaggaaagcaactggcactgtacaatctctcgccatcaaccccaaaatgagacctccagccagcttttctcacttcttgcaaacttctgacagtggtgtaattcctaatttgcaccagtttttgaactccgctgtgtgatttcttttttggagatagagtctcgctccgctgcctgggctgaagtgcagtggtacgatctcagctcactgcaacctccgcctcctgggttcaagcaattttcctgcctcagcctcccaagtagctgggactataggcacagactgccatgcccggctaattttctgtattttagtggagacggggtttcaccgtgttgccaggccagccacaaactcctgagctcaggcaatccgcccgcctcggctttccatgtgatttcaaatagttactgttcactgagtgcctacctagcaaggtgcaaggcattaacacatgttatgaacacagcaacctactcgcaggcatggggggtcacacagtcccaggcatgtccatcgtctcattcaatcctcccaacgtgacaaggtgagcagaacctcatctccattcacatctgagaaaacaagctccaagaggcaacaaccaggttctataatagcagggccaggatgtggagtctgactggcataacgagtccaagctccccttaccccgccccactcctttttttttctttgagacagagtctcgctctgtcgcccaggctggagtgcagtggcgcgatctcagcttactgcaagctccgcctcccaggttcatgccggtcttctgcctcagcctcccaagtagctaggactacagatgcccgccaccatgcctggctaatttgtttgtatttttagtagaggcagagtttcactgttagccaggatggtctcgatctcctgaccttgtgatctgcccgcctcggcctcccaaagtgctggaattataggtgggaaccaccgcgcccagcattttttttttttttttttgagacggagtctcgctctgttgcccaggctggagtgcagtggtgtaatctcggttcaacaccacctccgcctcccaggttcaagtgattctcctgcttcagcctcccgagtagttgagactacaggcctgcatcaccatgcctggctaatttttgtatttttagtagagacagggtttcactatgttggccaggctggtctcgcttttttttttttttttttttgaggtggagtctcactgtgttgcccaggctggagtgcagtggcacagtctcagctcactgcaacctccgcctcccgggttcaagtgattctcctgcctcagcctcctgagtagctgggactacaggcgcccaccaccacatctggctaatttttgtatttttgtagagacagggatacaccatgttggccaggatggtctcgaattcctgacttcaagtgatccacccacctcggcctcccaaagtgctgggattacaggcgtgagcctctgcacctggcccaccctgccctactcttaattgttctgagtcagtttcctcatctacaaagtcaaagtggtgaatgagaccagtgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcctgcctacttccttcaggtctttatttatttagaagtcctgtttgcaggggcgttccctggttaccctgcctaactcttgcctgtttaccaccacctgacacgccacgcctccactttccagcacgtcatttaccccatttgtttccttgactagaacaaagctggggctttttttgttttgttttgagacagagtctcgctttgtcacccaggctggagtgcagtggcaccatcttggctcactgcaatctctgcctcccaggttcaagcgattcttgtgcttcagccccctgagtagctgggattacaggtgtgtgccaccatgcccagctaatttctgtatttttagtaaagactgggtttcaccatgttggccaggctggtctcaaactcctgacctcaggtgatccttccacctcggcctccctaggattacaggtgtgagctaccgtgcccagcaggaagctggggtttttgactcttttgttctgtgctgtgtccctggagcctagaacagtggtcggtaccacagaaactcaggaagtatttttttaataagtcctctaagtttggtggcctttgttcctgaaatctatctctaggctgctgaggcttgggttccacaacctgcctcctgcagcagcctcgacccagcctcctgcctctggccaggcttcctccaatccacatcactccagagacgtgacccaaatgcccaggtctgaccacaatcatgactttgctcatgacatccaagaagaaatgacctaattctaccaccaggctcccagagctcagcaaatccttctgctgttgcttatgttacatgtctgcttatttcatgagattctgagagggcagggccaatatctgactcatttgtgttcccagggcccagcacagagccctaccagcagacctaggcaattatttcactgggccaatcacataccttcctgtgtttcctcatcaatggaacggggccggtaattcctgccacgcaaaggcctcaagatatatggtggggcttaaactcaattatgcagaagagtgttctgaagaggacaacaccagcatgaagaaggaggccagttcaaaccctgggtgctccatctgagggatgcaggcctatgtcctgagcaggcatttctgcagctcctgctgcggcgggaaccaggctgggacctcctgcttcctgcccaggccaagagagaacccaggacctggcctggcctgccacctcatggccacagacagaattacaccacttgtcacagggtgagtaggcaccactgtcccccaccagcacctgaactatggagcaaagatcgtgactcccctttagagatgcttcgtggcagacaaagtgacctattcaaagtcacacggtcagcaggctaggacagcagaacagctggctctacccctcactcacgagctgtctgaccctgagcaagtcgcctgttctctctgggaggaaagcctggcggggcaggcacttcaggtgtgcccaggcctcagggtcccatctgtgagatcagagtgctgatctggtcaggggctcaaaaagtagtcatcaactaggaaatcaaatgcgtgatagagtcaagtgtgtatcatgatcgatgcatcgagcaaggggcaggcctaatggctgctgccacatgagacagtgatgagacctgcccaatcctaatgtgatatgaaaacatccccatttctactggcgacagccacagactgctatcctctgaattctgcccttagaccagaggagtgccctgacaccaggataagggaccctggtctagacagtggtgatggattggtggtcacagatcatgtgctgactcggttctccctgcatttcatcactttgctttcggtaacaggcacaagacccagaacaga

SEQ ID NO: 163 - DNA, 11778 bp, Homo sapiens
  source 1..11778: mol_type = genomic DNA
ttttacctgaatgtcacaaaatccttatgggaaagggaataaaacatcagataccctgatctgacttttaaaagtcttttcgtgatcgacacacagaaagaccgactccttgtggggcccggcaacgcggcggcacgcccacccgcacggccaggacagggaacgaggccgccagccctgacagtcccttcggcccctccgcagtccgctacggcgacggcccccaggcctcctccccgtggctccagttcaccttttccaggacacggcaacgggacccggccatctgcggacttttagacctggcttccctcgctcagcacatgcgtgtgggactcacacaccttgctctgtgtggatcgtctgcccaccttgctctgtgtggatcgtctgcctgtgtactgctgaaccctattccattatggctctgctgacctcagagtagctccctgagcaggaaacaccgccggccccaaggcccacgtgatggtgctgctgagggggactcgcgaggcagacaaagtcccgagcgtctacagtcgcacagggcacgccgacaccaaccgacaggtgtgagaggagaaaggaggacgccacaaccacggccggcaagttcagcacgcgttcctcggcgggtgacgggacaagaggacgatctgcagacacgtaaagatgtgaaaacgctgccaagctatgtgagcgagtgacatcgcggagccggaggagtcttcagggtcacatgaaccagtggtgggctgtggctcggagcccccacccaagtctcacggggaactgtgatcctgagtgttggagcagggctctgctggggggtgactgggtgatgagggtggacagcccccttgctggtctcgtaatcctgagttcttgtgagatccgatggtctaaaagtgggtggcagtggccgggtgcggtggctcaggcctgtcatcccagcactttgagacgccaaggcgggtggatcacccgaggtcaagagttcgagaccagcatggccaacatggtgaaaccccatctctcctaaaaatacacaaattagccgggtgtggtggcgcatgcctgtaatcccagctacccaggaggctgaggcaggagaatggcttgaacccaggaggcggaggttgcagtgaggtgagatggtgccattgcactccagcttgggtgacagagcaagactctgtctccaaaaaaaaaagagaaaagatgatacagacagcctgtgtttattgaaacaattcatgctgtcattaaaaaccttcccacagagaaaactatcccaaatggcttcactgatgagttctaccaaacattcaaataaaaataacacccattctaaacaaatggctccagaaaagtgaattctaaaggacattttccaagcaactctccgaggccagcatccccccgatgctaaaccagaccaagctatcacaagaaaaggagaccgcaggccagtccttcacgagcgcagacgcaacccctgcgaggcctggcaatgtggacccaacacataggagaagtgtgacactgtgtggtggaccagggaccgggggctgggggctcacccaaagaccgggggctcacccaaagaccggggctcacccaaagactggggctcacccaaggagcaggggctcgcccaaagaccggggctcgcccagggaccgggggctcacccaaagaccagggctcacccaaagaccgggggctcacccaaagactggggctcgcccagggaccgggggctcacccagggagcaggggctcacccaaagaccagggctcacccaaagaccagggctcatccaaagaccggggctcacccagggagcaggggctcgcccagggaccaggggctcacccaaagaccggggctcgcccaaagaccggggctcacccagggaccaggggctcgcccaaacacagggggctcacccaaagactgggggctcacccaaacaccgggggctcacccagggactaggggctcacccaaacaccgggggctcacccagggaccgggggctcacccagggaccgggggctcacccaaacactgggggctcacccaaacaccaggggctcacccaaacaccggggctgccttcacactcagacgtcagtcaggtcaagaccagtccttcatgaccacagacgctacccctgcgtggccgggcaatgcacgctgcggtggaacagggaccgggggctcacccaaggaccggggctgccttcacactcagacgtcagtcaggtccattcaccttttacaggaccaaaggaaaacctcactgccctctcaatacacgcagaaatacacatttagcatcccggacaaacttcaaggcacttttataattttaaaaagtaaactgaggccaggcgtgatggctcatgcctgtcatcatcccagcaccatgagaggctgaggcaagaggatccttccagcccaggagttccagaccagcctgggcaacatagcagaaccctgtctctaccaaaaaagaaaaaatcagccaggtgtggtggcgggtgccagtagtcacggctactcgggagggctgaggtgggtggatcactggagcccaggaggtcgaggctgcagtgagctgagatcatgccactgcactccagcccgggggcagaatgagaacctgtctcaaaaaaaacacaagagctcccagcaaacaagaaaccaaaagggaaggggcctcctgagtctgatgaaggacgccaggcagggccgctgcgtcacggacgacttgagcccgaggcgggaaggggcgtgctctccacggctctccagcactgcactggcaggccgagcctgtgtacagaaagtcagggaggagacaccgatgcagacgagaagagaaaggctgaactgtgctcacctgaagatgacctgaccgtgcgttagagactctgccggacttaaaggttgagctggtagagccgatgactgagttaaacttggtcagaaaatgcaaagtccacatataaaacctaacagtgcttctcaacattcacaattgacaatcatattaaagtaaaaaaataccacgtacagtgtcatcagaaacaggaaatgcttgggtatcaatgtgatgaaccgtgaacaagaccaaactacaaggcgtactgaaagaagtgaaagatgcctgaaataagggagagctggaccgcgttcatgagacggaagcctcaatatggtcaagattcttccaagttcatctggagtcaacaggatgcccatgtaatcccagcaggctgtcgtagcaacggagggaccggctctaaaattcacacggtgggaacgaacaacggtgcagccactcgggaagacagcgtgcaggttccccagaaagccggaagtggaactgcacgcgcacacggaacaccacgcgatccggccctccacacacgcacatggaacaccgtgctgtatatgccacaaacgtctccgagttctgtgctccaaatggttacggtggtgaattctgttgtgtgaattttcccataataaaaaaaagtgcctgctgtctgattctgtttacataaaattccagaaaattccggctaatctatattgacagaaaggaggcctgaggtagcgtgggatgagggcaggtgcgcgtcagaaagcagcagagaaaagtccagcgcacgtgcccgctcaagcgcaaggatgcagggacgcctattgtcttggtgctgtggatagtttcatgggtgggtacagacgtcaaagctcattgaattgtaccttccacacgcaccatgcatcccacatcagttatatctcaacacagctgccccaaaatgaaaaaaaggcaaactgatgagaaagaaacacgtaaggtggtcaacacgtacatcagggaaatgaggagtgcagccaggacgggacgcctgcacacgcacagaacggctaaaggcaaagcgtgtggccacgtgcccgcaggggtcaacgctgctgcctggaaatgcgtcactcagggccaccccggaagcagggttttttgttttttgtttttttgcgtagagacacagtcttgctcagtcgcccaggctggagtgcagtggtgcgatcttggctcactgcaacctccacctcccaggttcaagcgattttcctgtctcagcctcccgagtagctggaatgacaggtgcccgccaccatacctggctaatttttgtatttttagtagagatgtggtttcatcatgttggccaggctggcctcgaactcctgacctcaggtgatctgcctacctcagcctcccgaagtgctgggattagtggagtgagccaccactcctgggccctggaagcagttttatagcttcttacaaaactaaacatgtggccaccagatgaggcagagctcacctctgcggtattaatcacctcaggaaaatgcaagcatgtctgcgtaaatcagtgcacagacacacagcagctttactcacaagaagcaaaaaccaaagcaaccagacgtctatcaaccctggaacaggggagagatggagcacacacacagcagaagctactcagtgatagaaaagaaactgcccatacggccagggacacatagtgagccccacagtatccacaccctggccagccacacgggagccccacggtaaccacgccttggccagccacacagcgagccccacagtatccacaccccgccagccacacagcgagccccacggtaaccacgccttcgccagccacacagcgagccccacagtatccacaccacaggacttaatcagtcctcaacacacacacatagcgaaacatcttgctgtaccctgtatacacaaatattacttgtccattcaaaataaaatttaaaataaagatgctgccaggaagaagttagaaaccacagacaaaatgctccaagagtcctcatgtgaaattctaagagaggcaaagctacagcgaccggaagcacatctgcagctggcccgggccagggagaaaagaggggaatgatgaggtgcaaaaggaggcacgtgggacacccgcggcaggtgacaaacggccggtcctgcctatgaggatggatacccaggtgtgtgctttaccaaaatggatcaaattgtacacttaaaattggtgaatcttagggtgtgtaattatatgacaatacagctggccaaacaaaaaactattcaataaactaaaaaaaatgacagaaggaagtgtatgtaaaaaagatgaccatagatattcatgagagaaagaactgaaataatctgtaacactgacagctgctttactgaaagagatatacgttagtgtgtagcatgacggatcaagaaaggaaccggaaataaatgattctgtcaagaaagtgtctatgtatgatgcagatacgatcaagattttgtaaatcgtacaagacaaggaaaagctttagagcaagaaatttctaagttacgcaaaaaatttttagaaaaaatgtaaatcatcaaaatagtctccataaatgaaaaccctgaattagccaacaacgtttgaaggaaattaacaaagagaaaagtgtgttttcctgtgggggcagctgagggggtggagtttggtggaggtgaaggagctgatgactctgtctcaaacggcttcagagaaaacacagaggagtgacaatgatgaaagggaggaaatgatgtatgagatcagccctgactcacacagacaggaagaaccgggccaggagaaggcacacacggacctcgctgcacggccacggctaagatccacggggggacccccctcatcaaactcaaagtcccctcagacgtgagttctcaagcagccgccggccaaagtccacccgcctgacaacacgcgtgtggagctgtgactccaggccctcattcagtcactcacgcgacggggagaactcgaaacggcagtgacacccctactcgttcgtcccctgggccgggggcccggctcacagaaaaccgtcccaaaggcacacgatggagacgtggacggacatctgcaggtggcggcgagctgggcgccaccgagacaggctcagcagccttggcggggaagctgaagtttgcctgcggcccccacacacgcgggacgctcacagggttctgccgccacagcgcaggtggattaagtcgcgacagcgcacaccctgctggcctctgcccacagtcacggtgggtgctcgagcaccatgctctccgcctgcagggccgggtcggtgcgtgcaggcacagtggggcctgtggaggtgtctctcggactcccagcggtgcagacgctgcaagcgacacaacttcagtctcagagctctcccctgccccgctgggtcacacccaggtcaccctgcttctctggggcgtcgaagacaacgacaaaacttgctttttaccaccaaacgtgacatccagccaacggaccaggttctttcaagtcttaaagcctcactaccttagacggccaccaaggccagtgccgctgtgcgtggaagcgaggtgacaccgagaactgagtcctggaaggaaaatgacatgaaacgcgcacatgagaaccaggcgccgaggcggggaagcaccgcggagggggggtggccgctgtggggggcggcaccacggtggggggaggcgccgttggggagaagcaccgtggggatgaagcaccgcgtggggaggggcgctgtggcggggaagcaccgtggggacgggcgccctggcggggaagcaccgcggcgggggtaggggagggcggggcggcgccctggcggggaagcaccgcggccggggaggggcatcgtggcggggaagcactgaggggaatacatgggtcccatgcaggaacctcactgggctgcgcgagcggctttgtaggacccgaagcggacgcagcgcgtgagctgcaaaagaggtgtctgacccagcccgaggcgcgcagagaccctgtgggtggggccgggcgcactccgcgagggtgagttctccacacaacggaggctgtactgaaaaggatgaaggtgtcccagcagacggaatgccagcaaagagacctcccagtgaaggaactctcagagataccccacaacttcaagagcaccaaggataaaacgcggaagctgagcaaggcgtgttaagtcgagtgagtctgccagggcacggagcaggtgctcactccacacgggacaaggagatggcactgctgtaactacttttggcaagtttttactgagagatgaaacaattcttaatgcttctggtgttttaagttacagcatactaggtaaatattagttcttttcattcactacatgtttgcaaccgactgtaagaaagtttctaatatttcaacaaaaatgattatagaatgatcctaatttttactggaagatggttttgcatggttgtgacttatctggtcctttcatggccccacactgccgtacaagacagggacacctctacaaatacggagtgacttagcaaaaacaaatatgcaagtgtacaacagcatgctaatttttctctaagaaatgcaagaagtatgtatgttcatactcatacacatatttgtacataattgctcatattaaaagctaaaataacaataagaggataaaccaaagctatggaaactattacctctggggtagaaacagcacagacagggacagaacctggacttacctgaatgtgtctagtttgttagtgctcactttgtaaccatggaggtttttacatatttataaaacaaaactttttaaaatactttaaaaacacaatccctaatagaaaaagggcggggacacttaatgtgttctttcagacccgtattgccctaaaaccaaaaccagacaaaggactcacaagaaaactaccaagcactgtcttctctgtgaatccagttgcaaaattattggaatccagcaacatataaaaaagatgagacacagcgaccatgcggaatttatcccaggaatgcaaggttggtttaacatcccaaaaccaactcatttaatagactgtattaataagttaaaaaaacaaaacccggccaggtgcagtggctcatgcctgtaatcccagcactttgggaggccgaggcaggcggatcacttgaagtcaggagttcaagaccagcctggccaatatggtgaaaccccatgtctactaaaaatataaaaattagccaggcatggtggtgcatgcctatagtcccagctacttgggaggctgaggcaggagaatcacttgaacccagaaggtggaggttgcagtgagccgagattacaccactgcactccagcctgggtgacagagcaagactttgtctcaaacaagcaaacccaaaaaacaaaaacctgctcactcccgaggacccccttcacagctgcagagctggagagggctggggggcaggggtctcaccgtgaggggctcacatgtaccgtgcaccgaggctctggggctctgacttggaggggtgggagcatccactggccagcgactccacctggagggtaggaggctggagatgcgggcacaggtccctggaaacacaaccacccaccaggggtccagacacgcatctctggtgtaggccttgccttggtaacggacagacactaaactgagtgtgctccatctgtgggcgtccaggcggtcagcctggagagcatgcagctgagaaggaaagcaggcggcgaatgatgcacgccgcgccgcagcactcagggtgagtctagaaatgggcccatggggctgctgccaggagacgggtccacagctgcccagcctgggatggccgctcctcgggcagaaaggggcaaggccaggagggtgcagaacggcctccgagagccacgagagctggcgccactggccccggaggggagagaaggggagggtggcacagggcgggcctgcgctcttcacagcatcaggatgagaatgcagacggaattcccactcgcatttcagatgcttaagaattcacacagcagcaaccagacagcaaacctcagaccacaactataacctcagagaaaacctgggccgctcccgcacacgtgtgaaacgcaccctcctcggccgtgccgcctcactcacgctcgtgtgacacgcacccaccacggccgctccgcctcaccctcacatgcccgcagtaccacctcggctgctccacgtcccacgcgtgacacgtaccttggccaccaggcccatgtcatccatggtggccctctcgtgggggaaccgggcgaaggtgctctcgatcttgctgatgacggcatccacgttgacggagtcctgcgggcgtcctctggggaagtagaaggtcggaatgctttggctcgtggccgggggcagaggctcttctttccgtgtctgaacctgaagagtcgacagacagcgctcagttagaacctgggagcatcgaacgccttcttcacccggacaacacacggggcctctctagggccgacagtgctgaggccacctgatcccagccgggagaggacacactgcaatccctgcgggggaccacacacgtactccactgcagggcccaccttcacccaggaggccacaccatgctgccatggaccccactctgggtggcggctctgcgccactgagcccccatcacaccgagcagggccctggggacaagggcagctacgtgccccaggcacctgagagcccagccaggacccactcccgattcccatgagccacaccactgaccccaccacacctggcagggacctggggaaaagggcagccacgcaccccagacgcctgagagctcagacgtggagaggcacaggtgccgtccacaggcaaccctgtccctggagcccggaagactcacattctgagaggcagaggcagggcaggcaaccacacagccaggagaaggggtcgaccaccaggtactgctgcggacacgcctcagcccctcacccggtgcacagcccacgcccacgggctcttggccccactcagcaccagcactctcctcacccagtatatctgcaggccccagaacactcactcaagagtctcctgcttgcatctctacacaacctgcgaggtggacatttgatctcatcccgtgatgttaaaacaccatctgaaacagttaacagcatcagcaaccgtactgcgtcctcctccatcaactgcccaagggacggtgctgcgtcctcccccaccatcaactactgaagggacggggctgcgtcctcctcctcctccaactacccagggaacggggctgtgtccttccccatcaactactcgggacgaggcttcgtcctcccccatcaactactcaggggacagggctgtgtcctccttgaccaactacctagggaatggggctgcgtcctcctcctcctccatcaactactcaggggacggggctgtgtcctcctcaaccaactgccatggaggaggggtccagggaggaagtccgcataccagtggaccacagctcagggcctttgcacccacaatcctgactgcctggatcaatccaggactgggtccaagctccagtgtccacacagagaaaacagcccgccctgctactcccacaggaccctcaccccaggtcacaagggtcccacagacagcaccccaactgtccccaccctgctactgccacagtatcctcaccgcaggtcacaagggtcccacagcgccccaactgtccccaccctgctactcccacaggaccctcaccccaggtcacaagggtcccactgacagcgcctcaactgtgcccaccctgctgtcgctgcaggaccctcacccacggtgagactcagttgtttttctctgatccccatgtaggaggaacagaggccgcctccgtgacctggggcagagcaggcttcccgcagtagctgccgactgagtgctccttcagcacagctttacctaagggcacaccccttccctgtgattcagaacgtgacctctgtgtcctggggcaggaggtccctgcatctccccgagcccgcgatcccacagtgcatctccccgagcccatgatcccgcagtgcatctccccgagcccacgatcccgcagtgcatctccccgagcccaccatcccacagtgcatctccccgagcccaccatcccgcagtgcatctctccgagcccaccatcccacagtgcatctccccgagcccgcaatcccacagtgcatctccccgagcccgcgatcccacaatgcatctccccgagcccaccatcccacaatgcatctccccgagcccagcatcccacaatgcatctccccgagcccgcgatcccgcagtgcatctccccgagcccgcgatcccgcagtgcatctccatgagtccacgatcccacaatgcatctccccgtgcccgcaatcccacaatgcatctccccgagcccaccatcccacagtcatctccctgtgcccaccatcccacaatgcatctccccaagcccgcgatcccacagtgcatcttcccgagcccacaacgcattcccgcagcggcgccttcccgtctctcgctgtgggggtcccactgtggagcctgcggctcttcctccttcatcacgctgggttcacacagctctgctatttggggtacggaactgaccccgcgaatattctgcagtgagctctcgggctcctgtgtttggcaatatagcaatgacctgggtacacaaaccaaccttcctgatgaaaactgccaagaaccctgg

SEQ ID NO: 164 - DNA, 245694 bp, Homo sapiens
  source 1..245694: mol_type = genomic DNA
attttgatttggtggatattaggttctaagttttgcctagagactatttagaggggctcagaaataccacgatatgtttcatttcttagttcatgtctcgtctctgtagcatcattttcaccccaactctgaagataaatagcattgagccattgaagatgaaactcacttatcaatccctatgtggaagataatgccatcgaccaccttctgtcttaggaatacatttcaaaaatggaaagaatgcttctctgacctactctttcacttgtacctccttattaaaaaccaggcctcctttgaataggagactcagcacatttgtctaccctgctggcccaaaccaagtgagcataaatccttaaatcctacaagcacatgcacatggtcaccaaggcacaagcacaccatgcagtgtgaacttgagtaaccaatgaggactattccaggacttccagaggttcctgttctgagccactgttacatcctgggagatggccactctccattcaatggagattttttccccctttttgtagcatgaggtataagcacctgggtaaagtgcagttatttttgagtttgacaagtgagcatatattattgtttagcatgccttctttgatgttcaagctcaggagaaaaatctaaaaaaatacacaaaacgtccagatagaggattattgatctacacttcaacagtaaaaaaaaatacaatagatttttcacccacagactttttccccttactctgggaaagaccttttactagcaaagtatgactctagattgtcctggtctgtagatatacaaatattgacatggaatgcaacataaagcatacaagtagtttatcaccctaagttattatcctttttaaggaatcaatcactgtaaaattggccatgttgacactcatatggatattacttacttgataaatgttgaaatagaccattcaaacagatgcattcttaatattttgaagaaatgcccatcttgaaaatgctgcagagattttcctccatatatttttatctgaaaaaaattggattcagctaccagagaatgctccatatttactattagatttactggaaactgaaagaacagaatgatgttgcctctatagtctgacatatgctgggcatatgtaaaaagaaaatgaaagagtacgtttgagtatgaaatgagcattcctttattttttccctgcaaaaatttttccttttttatttttttactgaaaaaataaggtacttaacattctcagatatatgatactccatattttgtctggtaacagggaaaaaaagttattaggatacagtttgtgagtttttgaaaaacaacctgctatagcacatactctgccaggtctgtcagagtgaaatacctttgaaaatagaactgactatattttatctgcttagtttaaaaatggagcgagttcccttgaaatatgatttccaagttttgaagtcattatgagtgaatgcattctattctaactccagaggctttccgagggagaaactgatgggcccaggaaggagatagtcacccgtccatcctggtcttgtccatataattcaataggcttcatagagacatcttttctttaatcaatttaaatgtcatttttaagactaatttgtacagaattgttgtccttattaattcccttgttctctatggagtgatttttcagaaatcattactcttctctctttttgcagttttaaagctttgggcattaaaaattaatttttcatttttttcttcattttgatcaatttcctgaaaaagtaaaatgatgcagagtgtatactatggggtaatactggctggttactaatcttaagtctgcatttactaaatgtgtgatcttaggcaaatgactggacttctgggttattctagattactttttggtttgttttattgtaaaatggggataataaaagtatctattttatgaggttgtggtgatgatcaggaatatatgtgaagtgtattggacattacatggtgtatagtaagcaagtcagaagtgtttgttattaccgttactacttaacaacattaaattatattaaacattatttaataacattgctgacatttgctttgccaatgtaggaaatctccttcttcaatcctcttgcttccattctcttaagctaaggtgatagtttaatcaatttggggtaatgttgatttgatctcatacctgaatatttgatatgccttaattcctcactttcaactgtgttaggtttttgtttgtcattttgtgtccacatagaggagggacttcaattcagcactgatttttcaccttgaaaaacagcataatagcagctttcctttggggacaatcaaagacaaaaacaagcgatccacttcccctgcctagccccttttctcttttcctctccatttcttccaaacacacaggtattgcagaaggtacctttgagggctgtgtgtgggtaatgatgtggggaagagcctggctgaggcacgcctgtctatattgacattttattaaacttatctacttaccatgttaacatgtgatgctttttatcaattccttccttgaaggaagcacagaatatccatcatcttttaagtgcttagtgcttgtaagtgtatgtcacttcacagaaaataaatacttttcttatgagaaattcaacatagttcgagggcagctctcatgagcatcttctggtttaagtacctgtcaggactttagccagtgccgactggggtttgaggtccttgaaatcacatattgagtactgacctgcagagagggcccaatacatgttatgcaaatgaatagctgactggaagttcattctcactgcattgcaacaagtgggtgggaaagaagcagggggagagggaggaaggagagctgaaaggtagcaccgtcacccaggagagaatgatgggtgtctgacccaagccagaggcaaggcatgttgacaggagaaaacagattcaagggcccatggaagatgagaaatagtggactcagtcccaggtgttcattcatccagtggtgggagagggagggtggggaagagaggagtcaatgatgaagttgtgtttctccacattgaaggagaaattgtgatgctttttatcaagctggagggcacagaagggaagtcaagggtagagcacataggatacgtattaatgagatgtccaaaaatcatgtcatttagggttccccagagcaggagacatccctggggaaactggtgacttgttggctcctgggttgaaggagctggcaaaggccagactaagacaagaggagggtcaggaaggaatgccttggaactgagccatttcagaggatttggataaaggaaagtgggggtccacgagagatactaagaagacatcagaaaggagggagcgaaatgaagatgtccacggaaagcagctaagaagagaaaaccaaggatgccatgtacagcaattgcatcaaatataccagggaccagatatgtctattttaaaaacctatttattttattgtggttgtcagagccaagggaaaagttcacacctttgccctctgaagttttgctgaaaaatcaactcacaaaaagcagattaattggagaaaaagcatataaatttatttaaaatgtgcacacaggagacttcaaaatgaagacccaaagataccggagaaattgcccatttttatgcttaggttcgacaaagtttgaaaagctgtgtagaaacagggttggacaaaaagggcctgatctaatgctaatagactgagcagggaaacccagcaagacctgtctgtcgagattcttcttggcctctctgagcaatatttctcccttctgggtgtggggcaggaccctctggggtcttaaagcacttaagactctgaggtcttaagaccctctggaatagggggtcttaagacctaaagtctaacaaggtaggtcagggaattttgttatggccaggttttacacagaaaggcagagggaaaattagagtcatacttttagggttttatggctgaatttggagaaaaggggttttggtttctaggacctgccttggggaagagggattctagtttctgtggtgcctctggaaagaatggaactgagagacagaagggcaggagaagatcagagaaatccttctgtttctgagaccttcactttgggatattgttttatgagccccaacatgatgtaatttacatacagtaaaattaaccctttaagtgttcatcatgtgaatggcatatacagtgacagttgtgcaacaccacaaaatgaagaagatatagatcaactttattaacatcactcttcctacacaccttccagaagtacatgcccttttacacttaacagcatccacaatgcaggccctggccagtactcacctgttctctgtccatatagtggtgcctttgcaagaatgtcatataaatggaattacaaagtagtcagtctttgaatttgccttccttcacttaacatcatatacaagagataaatctgtgccactgcttacaagtggttcattcctctttattgctgagtagtattccattgcatggatgcaaccacattccccattcaaggggcatgtgtactgtctctattttttcatctgttaagttgagttaagaaaatgttactggtaaccaaggcaaaagctgttttagttcagtggttggaatgaaagctgaacagacgttggatgaggagggaatggggagttgtgaagaggagaaggcaattttagtttaatattttatgaaatttggctgggaagcaagggagagacagtgatctgtagttccaatgagaaatcagctgaaatgaagattgttacttttattgtaggaaaatagatatttaatcatacttaaagggggatacttaaagggagaatacagagtttttgttcctgcttgtttgtttgttttactgttatgatatatacacacctgaaaaacatatccagtagttagcaaaattgttgtctaaaaatagcagggctcgtgggaagatatgtgggaaatacttttctcaaaattttttgaactcaactttctaacctaattaaaaaaataaatataactgtatcaaaaacacaggaaatgcagatgtttaaagtcctatttttaaaaggatgccaaaatgagtgtagaatattatcataaaataaatagtgatagtttaatgggagggggtgcacagaaggtttcagaagaaacaggcaaaaatgcacaaaagtcagggagcaccaggtaataactgccagaaagagaaaatggggtgaacgggaattgttatagttctctttttttcgtatggggctgatgccttcatgcttttaaaagtacactttgtattcctttgctgttatttggtggtatgaaacatttatctctggaatcaaagtaatataagccaatgcaactttcacatttttctgacattattcttccatttctcaatggcctatcagctaattaatgataaagaaatgggtatgtatctgtagaaataatgatgttaaaggtgcaggagagacaaagtaggtggagtgaggtctcaaataatttaggatgagatagcatgaatgtgagtaatcccttaaccatgaagtccctttaggaggcatctaagtcaactccaccatcttatgagtggaccacattgaataactcatagatcgttaacttcacctcccaagtttaattggaaacatttttcaattgttgaaatcattatctaccatttttttaagtgtttagtacacatctcataaaaggcaaagatacagtagcacacagtggatacattttggataaatcgcaaggtgaagagttatgaaagctatcagtagattatttcattttcatctctctaagtaagctttctattcgttctattgtgtgtcacataccttgttcaagtgtgaacttatattaccacctccagcttgtcaggcagaaccggacaggcttgttcaaagatcagggcaacaacttcaaaatggcggtgccatattgcaatggccacagaatttgaggggacttgaccagtgttcgggcttatcctagatgaggtggtacaatatcaatttcagtctgcgatgaccataatctaacaagcaattgtaattcttcctttttcaatgctccaataatttccctgttcaggcttcaatgatacatctaggaagtagtttcataattatctgtgcatgcattgatatccccaattaaatttgaactttaagagcaaaaggtttatatcccttcatctgtgaattcaagctgctagtctcctgtctagcagccagaatgtgttacaatcagggactattggatatatgcatgaaaagttaaagaagcatagttatattccaactactgtccatttacttaaactgactacactcattctatcttttaccaccagacctgaagcactatagctaaacataaaggtagagataaaataccagaacctgagacagttctaggaagagtaaagctaactccctggcacagcattgctcatagacaggcagcatgaaggaagagagagggtatcctgtgtgagaagcagacctgggttcaaattctgactctagcattttgtagctgtaggagtctgggtaagttatctagtccattgcttctcaaagtatagtttcatgagctgcagcatcagcatcagcatcacctgcaagcttattagaaatgcagatttgcaggctccattccagatgtgccaatccagaaccagagttcgaattttaactaggtccccaggtgatgtgtgtgcatgttacattttgagaagcactggactagacactctgaattttagtttcctctattgtaaaatacagaaaaattatcaatcttccgaaatatgaagtctacaaaaatgcatgtcaaacacctagcagatagtgactgtgcaaaaatgaaagctattaataacaggaataataaaaaaaacagtaagaagtttagatattgaaggtgaagagaactggaagaaaagacaatagatatagatatagatatatctttctctctgccaatctatggcaatgaagtttctagatttgtatttaacttctattatggcaatggttctcaagtggggactcttttgtcccaggagatatttggcaatgtctgggaacatatttggatgctatggctgggtggtaaaaatgtgactggcatctagtgggcagaggcctagatgccactaagcttcctacaatgcacaggacagccccctataacaaggaattatccagccccaaatgttagtagtgccaagattgaaaacccctgaaatagatgcttctagaaatgacacatgttgcaagtggaggtcttccaatagggacacaagtgaaaactatataaatgtactcaaaatatcaactatgagttggattatgcaaatggcttgggaaaggaaatgaggaatgaatcaaagactttaccaaaagaaacattttccccatctccaagctcaagctgttctattagttgtatctccaagaaagttaaattggtatagttcttgtcctctaggagattatagtaaaagctggggattgactattaaggcatttgatgatacggatgcaacacattatgatataaaatgcgagatattttataaatcaaacgctgaacaaacatttaaaatgcgggcttatctcttttagttacaaaatactcttaatgattttaatgctcaactttatcttgcctgagtacttggttggtgaatattacttggagaattctttcatttacaacaaatggtcacattagttctctgtaataaaacacagtctgggtcataaaaacacacatcaaaagaaaaatttgccttatttattacttcaatttcatgcccaagtttctcttgccatgcctctttttattaattttatgatttttatggtttatttgtaagcagagtgctgtcccaaaatggatgaacctgtttaccagtaaatcagtaaactgtaaacattgctataaaataaagaatgttgttgtgataaatcaaaaatgaagaattctaggtatcccaagagagcatttttggtaggttacatcagctaactcaactcctgcacccatgaatcagtaatgtttgctggtttatgagccttggaaagcacaaatattcccatttctcctgctcagcacatctctgtagtaataagtaggtaattggttttgtcctattacactctttctatattaccctttgcaataatcacatataaatccacaggattatggtttcctttatcataaatttttcatactctaactccttattcttcctttcttagttgtagcacatactccagaaaaatatcacaacagtcaaacaacacagatgcttttgctttttgtgttcaaattattacatttctcaccattaattattttattaatgctgtaagtgaacttaccatctaaaaatacattatttttttctctcccatatatagatctcctggaaatctccaatacagagcaaaaattccacattaaatttccatggggaaagcaaaattatcatcatattaggataccattcctttaaaaactgaaaagggccttggagaagaatttgcacagtttttctacagagaagagtaaagtttttaccctatagtacataaaacacatagatttaaaaaatccaaatacaactaattttttttaattaaggtgaaaaagaattgcagaattttaggtaaaaacacataacatttttgccagtgctcaagatatttttgacaaaatattctccctaccttaataccttaatcatcagactagcatgttttcatttatcctctctctttctctctctgtctctcttcatgagtattcctaaagtcccactcagaaaatatttttcctttagttgactctgagtcagctgatgcagacattttattattcattgactaaattccccttcaatgggacatacccttagtagcagtattgtgaagctgaggcgtccatgtttgtgtatggggagcttttcatgcccctgtatccccgtgttaggtgttagtagtattgtctggcgtcacagacttggacacttaaggggaaatgtgttcttctacaaggggacagagaagagccttgggagatccaggaggctgcttccttttcacaccatgtgtaatggtcagtgttcatagaagacagtattaaccctacctgggcagcacttgagatgtcatgattgcttacattggtctcattccatcaagtaaagaaccctcatgagtagaagagccatctacaataaagagggatttgaactaggtagtgaaggatgcaagcggaaaataccatatggagtctgtaggttctacccatatttcctgttttggtatctcacttatttacatttttaaatcaaatgccttatttccttgtcttttgccctaaaatgatagtgtatgttggctgtgatggctaaatgtaccacttactacctctattgttgaatattaacatggatccaaataaagccagagaggagatagatattcccatgatgtccaggactcaaggctgggctttcagttgtctcctttcagggagaagtcagtcaggattttattgtacatggaattgttgcaacgtgttaggtggaggataattatgaaaatgtatatatgaagaagagcctatttttgggtagtggagcagcaaggaatttcatgggagtttttgtttttgaacacatatcaatcattcatcactccccagaatagtatcttcacttctttgcgcggtttgctatgtcttcatcgtgtgcggtcttataagggactttatgataaaatggcctccaagaacatcgtgaaagggtgagcatgtaatccatgttagagaaattggattctcttttcaaggcctttgaatgttacacagggcagaaaaataattggagctcatttatcccaggagctgtacacaaagaagcaatcaagcaatcattatttcctggattctggagacacctttgtccttgttagtttctggccctaattctttctgagctatgaatgatcctattgtttaaatcatttttgtttctttccttaagttagctagcaatggtttctatcactgggactaataaataaatccacattgacattccttatgactaatttcaacatacgatagtttgttaggtgaatatgatttacttaaaatcaattatccgtctggttcaaaacactagattagtcattttcctgtttttttaatcattgagggtgcccagtgcagaatattgatattattgtaaatcttatatttattacaggaattgcattaataactgtaacagtttaaaataaaaatcagaatgcctttagtaataaagattcttccattgaaggactcaagactgtgaaagtcacaataattaaattaacacagtagggttccatttcctatggggaaatagctgcagttataaacaaccattagtattcccagtctccaagtcacaaccagtagaatgaggccaggctgggtattaagtcagaggcagattaatggacattctggtaatatgaagggtaggaatgattaaagggcaaactcattgcgacatgttgtaaatgaggctgtagtgatgtggaccaaaactgatggggccataaccactggttgaaattgaatcagaaaacccctgtgtgggcatagatcaccacaatgccaataattaagaaaagatacagatgatcgattaagtttgtaaatagcatgtgacagctgatttctatgcaaatccatttaatgacagctaagtaaatgaaattgattgataagtatgactgttttaacttgagaggtttaactagatgtcattgtcttttacaaacacttccacaccctccaatattttgaaggttaaaccttttgaaatttctcaccctaaattaaaattagaccaacagaaaacatatgcattggtgagaaaaatacctggaaaatgataattcattgaggtcatcccttctaacctggactacataccttattttgggaaaattaacaattgcccaaggaaaagctactacaatcctcatcttgtcagctcttcctctatgattaatgaccagagaagacatttctaaggattgtctggaacaccctcagaagaaacatgggcttaaatttaagacatacagaatgttaagagtttaaactactctctgagtatataggatacttgagtcatctttaagaaatcattgtccaaggaagatgaaatttcaggctgaaaatgtcaaagtgaaaagcacaatacattgcttattctgataactggatattgactaattggttgtggtacctgtcccacagaagtgatctgtattagtctgttttcacgctgctgataaagacatacccaagactgggcaatttataaaagaaagaggtttaactggactcacacttccccttggctggggaggcgtcacaatcatggtggaaggcaaagggaagcaagtcacatcttacgtggaaggcggcaggcaaaaaaagggcttgtgcagggcagctccgatttttacgaccatcagattttgtgagacccattcactatcaacagaacagcacgaggaaaacccgaccccataattcaatcatctccatcctggtccctcccacaacacgggggaattatgggagctacaagatgggatttgggtggagtcacagagacaaaccatatcatgatctaactgactttttaaaattattgttattttttattataatagtatgcaaccttagaacatatatccccttgtaatcttcagtcttctcttgcacagatgaatgagtttatatggtgctcctgtttaattattcagatacatacagtaaggaacagttaagatcaattatgaaagaaacagtaacaacaaactactacaattaagcaagtgtgtggtttacaaaactaatctagatttatatttgttattttcttacattatacagttgtttagggttaaatccaaaatttcctcagagtattgccccatgaaagctaacatctcttcatctaatatttacttctcaactatgagctatggtttgaatgtctgtcaccttcaaaactcatgttgaaacttggttcccaatgtagcagggttgagagatggggcctttaaaaggtgactggatcatgacagagccctcatggattaatttattcaacggattaatgggttaatgcactaatggcttaatgggttattatgggagggaaactggtggctttataagaaggggaagagagacctgaacgagcgggttggcacattcagccccctcaccacatactgccctgcatcgccttgggattctgcagagtctccaccagcaagagggctctcaccagatgcagcctctcaaccttagacatctcagcctctatgattgcaaaaagtaaattacttttttttaaataaattaccgaattttagctattctgttataagcaacagaaaatgaactaggacacatcgtttccatgacttatagaagttatgaatctgtttgtttgcattttctcaaacagatatcctattcttgattaatatatagcatatccattttttaaagcagtacttgtcaaattttaatgtttatataaatcacctggggatctttttaaaatacgaattataatttagcagctctggagcaggaactgggattctgcattctaccgcccagctgctaggtcatgttcatgctgcttcaggtccttggggtagtcaggcttaagtcagggatcagccaatgtgttctgtaaagcaccagataggaaacatttctggtctagatgatctgtgccatctactcagtgctcccagtttagcccaaaagcagccagagacaatgaaaaaatgaaacactgtagctgtgtttcagttgagttttatttacagacactaagttttgaattttatattattttttctttcaggcagggtctcactctgtttcccaggatggagggcagtggcatgatcatggctgaatgcagcctccacattttgggcttaagtggtcctcctgcctcagcctcccaagtaggggggactacaggcatgtgccaccatacctagttaattaaaaaaattttttttgtagagacagggccttactatgttgcccaggctggtcttgacctcctggcctcaagcagtcctcttgccttggcctcccaaaacactgcgattacaggtatgaaccaccatgccaggccaaaatattatattttaagtttttttcaaacatttaaaaatgcaaaaaacttccttagctcatggactgtatgaaaacaggtggggggccagatttgacctgggaccatagtgcactgatctctgctttaattcatcattctatagtagattgagctatctgcaagaagtggattatacttgaataaaaacaagacattctcctccatccccagatgcaagttgtttatgggagttatctgaaaaagcaaaagaagtaaagagtttcatgtgcttttaagaaaacattatcctgggagattagacactaagaccacatttgttttttcatgtttattttaatttctggaaattatatttagagaagatatcaaccatctgtttaattgttctgtatttaatattacactatggatcaatgggacatataaaatacatttagtatgatttatagagattaattattgtccaattatggtttaattggagctttaggacatgactgcaatttctttttatttaatatttccatatgtccatacagttaccactaggacaaaatttaaatatctatataaaccattacattagagttttgagcctcgggtactgtacttagcttggggaaaactgttatatccaggtaaaatctctcaccctgttcttacagaactctgacaggactgtgttactgttgatgtttgagttttactttaacttcttttggccttgactatgtaacatccttgctttctggggtggtgtagctttggaaaactcagaataagggtggcctaatcctggaagaacagaaactgtatggaaattataattctgaaatccagaacatggcatgccacttcatcaattctaagataccatagattgaaagttgtatccttattttacatgccactaaagaatgagggcatgtaaaatacacacccacacacatacacacacatctaaaacaacaagctatccctttggcaatgtcagtccatcaattttgagtcacatgctaatttcatatctgggtcttagaatcaatgaaatatggtctttaaatcttaggtgcacatttaggctggaattatctaattttgcatttatgtgagatgatgattatgataacactgcttataatactgattacagcatccaaaatatattattttcattgcttcttttccttctagatggactaatgtgattttttttatgataaaatcgagtctcagacatgtggaatatcttattcgatgttgcacagatactacattcgtcagggaattctagctgctaaaataagtgaatccgagcacatgtaatggctccaccatgctggaagttcatttatcattcctgcaaagaccaaaacaggcatccttgatggaaggcagctgttccccaagcagccaatgggaaccctgagctcttacatcctatggatctaccatcttctatgaatagtttccaagttctccgtgcttgtagtctcaagtccgtgcaagtggaaggaatacaaggaagtgcacatgggaggtttttatggtgtcgctcaacacttccgctcacattccttcctctggaagtcagtcatgtgatgcccaacctcaaggaagttggaaaatgagtctagccttggaccaggaagaagagatgaattagtattcaagctagaatcctccaggtttcttgtcctctccttctgaactgaacccctcctaacccttttaatgtctacattccaaattctacctcaaaggtagaagagagccaagatcaatgatttaagtgatcctaacagtttcctgaatttcaagttttgtctatacattagcgccttcttttaatttcagtgctccaagatgggcaattatggatttcatttcctgcaagtttactatagcactcattaaattatgcagagtagtatttcttcctatgctggggatattatctttgtgttaatctcctagcctatggtatcggcaagtggaacttgtaatattttagcaccttggaattttagtgtaatggttctgacagcaacttacatttgcatgggggtaggagattctttctgaagatctgtacacatgttcatgcatttcatccacactgcaggtttaaaaaaatccatgacagtgctagaaataaccaagctataagtagccagtgctagaagaaaattggctcattttaactagagactggtagaatagatgagactgtcaaagacacaagagtgtttttgccttcccttttccctgtggtactttctgaatacattttatgtttcttatcctggtcgtgaataagagcccatcattgccaactggaggagagtctgccaggcacaccagcagaagcagttctctttgctctacttccttattgaaatgtcccagtgataggtttgaagcctcagtcatcaaacagcttgagtttgtgataatctcatttagcctgttgttgtgatttttaaaataacgaatcaattatccagatgtctttgcagggttctgcaaagcagaaatagtgtcacttatgggaccatagggacaacttcagtaatacaaagattagagatcaaaaatgccaatgttgatttttacgtgtaaaaaaccctaaagactccacataaaaaactgttagaactaacaaataaagttgcaggagacaaaatcaacacacaaaaatcagttgcatatctgtacactaacaatgatctatcaaaaaaaggaaattaagaaaacaacctcatttgcaatagcatcaagaagaataaaatacttaggaagaaacttaaccaaagaggtgaaagatttatatactgaaaatataaaacattgctgaaagaaataaaaaagatgaaaatgaataggaagacatcctgtgttcatagattgaaagataacattgttaaaatgtccatactacacaaagagatctacagagtaaatgaaatccctatcaaaatgccaaggcatttttttttgcagaaatataaaaaagcctacaatttacatggagtcagaagggactccaaatagccaaaagattcttgaaaaagaacaaatttggagatcacatgcttcctgatttccaagcttattacaaaactacagtaatcaaaacagtgtggtacaggcataaagacaggcatgtagaccagtgggatggaatactagaaacacacgagaaataaatcctcatgtatatattcaaatgatcttttacaaggatggcagcactactcaatgggaaaaggatagtctcttcaacaaatggtattggggaaactagatatccacatgcaaaagaataaagttgagcttttaccttatgccatgtacaaaagttaattcaaaataggttcaaaacctaaacaatatctacagctataaaagtcctagaggaaaacatagagcaaaagcttcataatattggtcttgacaatgatttcttagacatgataccaaagcccagtcaaaaaaaccacaaattgacaggtgagactacatcaaacttaaaaaacttctgcacactaaaggaaacaattaacagagtgaaaaggcaacctacaggatgggaaaaaaatttgaaaatcatgtatctgaaacagggttaatatctagactataaagaaattctacaaccccaaaacagtaacaaaataaaacaaaaaaactgattaataaatgggcaaaagacttgaatagatatttctccaaaacaaacctatattaatggccaacgagcatatgaaaagctgctcaacatcactaatcactagggaaatgcaaatcaaaactacaatgatatatcaactcacatccattaggatgtctggtattaaataacaagaaaataacaagtgttggtgaggatgtggagaaattggaacccttgtgtactgttggtgaaaatggaaaagggtgcagtccttgtggaaaacaaaatggagattcctcaaaaaattaaaaatagaactgctatatgatccagcaatcccacttctaggtaacaggtaaaagaattgaaaccagaatatagaaaagatatatgcacactcatgtttattgcagcattattcacaatagccaagaagtggaagaaccattgatagatgaatggataatgtggtggacacatacaatggaatgttattcagtctttaaaaaaagaaatcatgtcacatgctacgatatgaatgaaccttgagaaaacaatgctaagtgaaagaagccagtcatgaaaacacaaatactgtatgcttccacttatatgaggtatctaaagtgatcaaactcatagaaacagaaagtagaatggtggttgccaggggctggtgggagggaaaatggggaatttttgttaatgcctacagagttttagttttgcaagatgaaaaagttctggagatcttttgctcaacaatatgcatatagttaacattactgaacagtgcacttaaaaaaaagatagtaaatttcattttgtgtgtgtgttttattaccacaattaagaataaagggttcaaggattgaggctagaggcttgctcatgatacttggcaaattgagtctaggtttctgggtccagtaatcgggtttgtaaaaaaagaaaacaaccaataaaaacaccttttactaaaaggttctcaagccataaacttgtctaaacagctgggtgaatttcaacaaaggatcagggttacagcgatattgacagactctctagaacccataaaggcttggaaattagttactagcatcagcgttagtaattagtccactcttttctgtaggcccagaactttaaaataaagacatttgccacttaggtcctatgtctaaaggccaattaagggcatcgtgtgcaaaatgatttaaaaatatgacatttagagtaagagagatctgactttacatatatatgccaccatttctttcatcgttcatagcaaacaatacaaaatgctacataatgagactgaggctgtgacacttcatatattcagaaacaattatgagtcatacccacaaggatctcacatatgtctttggaaaacactttcattatttaattcctgttagagccaactaactcttctgggtatctaattgaaatctgtagggccaagtgagagtcaattctttctggagaactggcttgctagtttctatcttacaatgtgtgattctggggattatagcactcacctgttttttaaaatcttccaacaatgcaaatggttgcaattttattggaagtattaaaaaacctcacctattgaaaattttacttttgactatatttttataattgaacacacacacgtatacactgtttttggagaaacagtttttttatacttactgtgtattacttgaaagtaaaaacataaattgttattccaactgtagggggggattttattatttgcctttgtttggcttccctatatgtatacatggaaaccggtgttcaaatgcaagtgacttattagagacataaaactaggtgaatgagaacatgagccaggaagtagaatgcaagcattaaagcaatatagtctatagaacaatactgagagctaaatccataaataattttaaaatttctaatagctacacttcttaaaatgtaggaaaaatcaggggcaatattcattttaataatatattttacttaacccaatatatccaaaacattatttcagcatgcaatcaatatactattattaaaaagatattttctatactttttctatataaagtcttcagattgtggcatgcattctgtacttaaagcacatcttagttcaggcagtctgcatttcagatgctcaattgggttgtggttagtggctaccatattgagctgcgcagtaataaatgagatgttataaggcagctatctctgtgtttgactggtgcttaatcctgctgagaaaatgctggtaactaaagtcagaaatatcctatgagagagcaagtgagttgtggtatgtattcagcaagtcctgtcacttgagggttgagagctcctcccaggggcgttaactccctcatcacttctcacctgccaatgggacagaagaaagtggagttcagtggcccgagaaatcccactgagaagtgactggggtgccctccaatagcaaaggtgagaggatattggtgggcagtgggcagcatgtgctacattattcaacactatttatacaaaggtcaaaacaagatctcactcccagaccagtcttctcttagacaattaaagcaagatacttggaaatctatctttaaatgtttctttcaggttcaaagattccacacttgctttcagaaaatactttcattacctaattactgttagagtcaaatagctcttctgggtatctaattgaagtcggtaggacaattttaaagcctttactcttgttcttttaggagaactggcttgctattttctcttaaaattcatgattctgaggactataccactgcttttaaaggctaccaacaatgcaaacttgttacagttttagtgaaagctcaaaaaaatagcctgatggaaagcttttacttttgtttgtttttttttttcataatagattgataagtccagctcacaaattactttggtatattttagtcttctattggatatgttcaagtatcacaattcctttaaacatacgtaggataacaaaatgaattgttaaacaataagactgaggctgtgatacttcacatattttaaagcaactactgagtcccacccataaatcttggttaatctatcttcatggcacctcaatttcatttcttaatatgcaggacatcgtttgtggaattttctagtttttccttactgatctccagttgagagatcaaaaccatcaaaagaacatgacgtacagagtaacgagattgaggactgcatcctgctatgtttgcttggttgagaaatgtactcaatgtcatagtttccagacatgcacaataaaatagcaaaaacttagcatgcatggatgtgagtgtaaacaaaaatttggtatttgaaggtacatacggcccatctaagagaccttcagggccagactttgaggccaaatctgcagagcgtcatctgattatctcaaggtggactctggtcttttcatagatggtgtgtgattgccatgaaaataaagataaacaaataaacaaacaaacaaaaaaaacaaggatcttagcccaaggctaaggctaaaactagggctagggctagggctggggtttggtttagggtagggtagggttaaggttagagctagggtgagtttatgttaggattgggttaggggatcttagccaattttctctagaaacaaaccttaggcaaagtgctggctggtgctttgctggaagcagcaatcccaaagccatggagagaggacctaaaaggcacagaggcagcgaaagatgggaaggaaacggaatgatgtgcactgcccgtgttttagtctgaaccacaagagatggagctggaggttgaaggcataggatgtctcattgtcaacaatatggtgcatccatgctttctgtgctttggagcaggatgagagaggacttcatctactcattcactcttgtctcctctctcctcttagcctctgttgtcccatagagagttgacattcctggacatctatgtggcttcacccgggccccttcagcacctactgaggcctgaaacttcaaccaagtttggaagtgatgggagatgctggagacttgggcgtgtgtcttgttagcttgagatggtggaggcatgcatgtctaccaaacatgtgggacattaggaaggtaagaaggtgtatgagagtccatacaatgacctatgccgcaagtaaattgatttttgtcctgcaattgtgccttgcagcttatttgctgtaggtcagaaattaagggtcttttggcatggcttcaaagtgtcatgtggtccagctctgttttaggtattttctgtatcaatacatggctatttgatgtgaaaaagtggttaacacttgaggttatgtgcaggtgaagcaagcccaatacatgaagtactgcgaagagccagcggcttttctttttagtactgtataaagaaaatatacacaaaattaaagaaatcctttagaaaacaaggtaaaatcatcatcacatacaatcctaccataaggtaaacgtttaattttagcacattatgttttactcattcagatattgtagggaaataaaattcatacacctaaagtattaaacataattttttaaatgttctaaaagagttctcaacttgcttgcaaatcttcctaataaagggaattataggggcataaaccttccagacaaggcttttgtgctgatgaaaacagtttttcaggttaattcactcttccctggtaaacactcagtctgtcaaaatatatcacccttttctctctttgactaaataggatgatatctaagattaaagggaagcttaaaattatctgacattatgaatattttattaaataatactcaatgtcagttgtcttgatcccatttttaaccataatcaataattctttcataaacatcttcatttactagttatttgttaaggcattaaattgattccttctcttgaatcaactttcttgtggaaattatctaagatattggtttgcttgttaaattatattttcctggtaaaagttacaatttttattttgttttactttctgttttctgtgcccccccccgcccccaccatttttaaattttaatttaatttaattttaagttccagggtacatgtgcaggatgtgcaggtttgttacataggtaaacatgtgccatggtggtttgctgtacctatcaacccatcacctaggtattaagcgctgcaggcattagctatttttcctaatgctctctccctgcctcgccatccccagacaggccccagtgtgtgtcgttcccctccctgtgtccacatgttctcattgttcagctcccacttataagtgagaacatgcagtgttcggctttctgtttctgccttagtttgctgaggataatggcttccaacttcatccatgtccctgcgccaccattttgatttttttaaaaaatatttactcaactatctagaataatgtcatctagcatattttttttctgctgtaaatggaatttgatttaaaaagtttcagttaccaagacactaaaagtgtctttgcctttgaatttctcctggatggcctcctaaacagtaggcagggattcacactccatttatgtgtgcaaaaaatgaagcagggttatatcatagggccaattgtatccatttatttagctcagatttccttaccattaagataggtatttgggacacttcacaatatacttcaaggcctccagggaaatctaaacaagagaccataaatgctcctaaacatgtctaacatatctacactgtcctgcggtgatgctaatgtatataccctttcaaagtgcacattccaggcagctcagagcagattatggggctctttgcagaataagcacagcccctggctatatgcctgaataataaccctaacttccatcacactttacagtttacaaagtgcttttaccatgcatatgggtgagcatatggttcagtttttctctaacaatcctgctttcaaatatattgcctaccgtcagatttggcaacagagtgcgtgagcctgttttggggcaagagaatgtatcccatcatcacatcctcacacagacaatatgaggacgtgtctgagatgaggggtctcttcactgaatcctcagaggaaccctatgagtaagcatctttgatgagaattctaagttccatggaagtaaaataattagtccaagttaagcttgcttataaatgcccatgctgggagtttaacttggatctctgccccccagtttgggcatttttacattattaatctatactagtgactatggcatatagctaaaataattattagcccaattagaaatgttgtaattaaattttatcttcaaaccagaacacctctgatgataggctaagtggaaagatggattctgaaaacagaatgttctttgaagtcatgatagtgagggatactatctagtattaggttgtcaatcaggatcaatcttaattcccaatatcctattaggattgagtctggacctgctgtcagttttgcttccagacccctggataattgaacagaacttttaaaaaatattattattatgttttttagagacagggtcttactctgtcacccaggctggagtgcagtgtcatgatcactgcagccccgatctcctaggtttaagcattcctcctgcctcaacctcctgagtagttggaaccacaggtgggtgctaccatgcccagttaattttttaaaagattttgtagagacagaggctcgctatgttgcccaagctggtcttgaactcctgacctcaagcagtcctcctgcctcagcctcccagagtgttgagattacaggcgtgagccactgcacctggcctcaacagacctttcactttaatctaaagagatgtaagagtgagctgaaaacacccccttggatgcaccgtgtgatgcttcaccctggtgcatggataccagatggtgctaacagttctgaagtgtagaattgaagtgttgaggtcaagtgtagtaatcatctgagcaagacagtgctttgagactattttccagtataaagaaacggtaatttttcagtatgcaatattatgataatgctgtgatactactggaatcatcttagcagcataatatgccataatcagatatccagctaaggatgatgcaaagtctagaagtaatgttctaaaaggggccaaacattcttcaaaatgcctgtaatcctgagccacgaggctatactcctccatgtgctgccaagtagggaaataatctcttgcctggtgttcttgagatctgcaagttctcccatacacagggatagccaagatgggttagcatctccattatttaatctgcaaagtatttccaattaaatgcagtactcttatttgatagtcaaggcactgccaatactgttttaaaagggtaatcatcacaaacttggcttacctcgtaattcacttcacggaccacccaaatcaaatattagacacaggaaataacacttccaggtctctcccttaatttaattctgaacaccaagtgacctcccattttgcacaaattgcagttattggagattaaataactgcactaaagaatcaatatcctggtgttgtaatagtatgtatctatctagtgagatgataaggagttaggtgtccatgtctgaaggcaggaatgttaagaaaatggtatttaaaggactttcctagaccctcggtctatgattaagatagaggaggaaataggaggtcataggaagcaggaactggggagtctgccaggcctggtgtggaatttctttctcaattttgctctgggctagggagtgcttacaagtgggatggctgatttgtgagtattttgcaccttccaaattattggtcatgacaaattaatgttgtcccagtgattgacacacccaccagagagtgtgggagtcccatatccttgagcctatgtatctcattggcattataatgatagtcggacatcgcagggctgttgctgacagatggaaagagaaaaatgtacagtatatgaaaccactttgcaaaatgcctaattgatagttgccgttcaacagtgttggtttccttccttgttcttttacgtgctttcacagcatgctgcacactcctttgctaaaccacttatttaatctattgatatttcattatttacaaacaaaattatgagtttctggataccaaaggctcttttattattcgttagacacctagaacttagtacatagcatttaatgtctgtcctttgaaataaaattaaaaattaatggtccaagtttatatgagtacttttcaatatcttagaacattaaccccataaaatttatctggtgataatactccttcataagagaaaaaaataaatacattaatttttaaaaataactttatcggccgggcacggtggctcacgcctgtaatcccagcactttgggaggctgaggcgggcggatcatgaggtcaggagatagagaccatcctggctaacacggtgaaaccccgtctctactagaaatacaaaaaattagccgggcgtggtggcgggcgcctgtagtcccagctactcgggaggctgtggcaggagaatggcgtgaacccaggaggcggagcttgcagtgagccgagatcgcgccaccgcactccagcctgggcgacagagcgagactccgtcaaataaataaataaaataaaaataaataaataacgttgttatgaactagtccatctaaggtacatgaggtacaaccagtagcaaacatactcatctacacatcccagcttcagcaataaaatatttaaatattattgaaataaaaggatgctctcttaaataaacaaataaatataattgaagacagtggtgtccatttccaaatttctccttcttcctcccactatctttatcattgtgcatattgctgtcttgcttttccttatagttttgatgtatatgtgtgtaatctaaacaatatgtttagttatgcatagactctgtagtttagattaatagtgttgtatcacattgatctctaacttttttcattcaatacctttgtgtaatccatccatatcaatattaaccatagtggttccttaatttgcactgattgtatatatatgtatatatttatgtaattccttatatataattatgtatattatcagtgaaaatgaaactactttgtgaaactatatatgcactcacacatatacacacacacatatatatacacacacagtgatatatatttacatggatatactatcttatgaataagcaccatcatttatatatactcttttttaagtggttatttgggtagctttcagcttttttactttttttcaatggtgtgctactataaagaatgggtctgtaaaattcttgtgcatgtccgctctatgcatatacttaagagtttctctaagaggttttaaacgggtgcttaggaagggaattactggatcacagaacataagcaacataaggttccagattatactacatttgtttccaaggtggttgtaccaacttacgctcccaccagaagcatttgagagttttcattcctctgcatcttgcatagcactagctattgttacattctaatattttctaatctggtagatgtgaagtgataaactttttaccttgtgtttttcattagcatttctctgatgactagtaatgttgaacatctttttacaggtccatttctggccacttctgcattctccctcctggcaagaatgttttcatttttacccatgttcttgaagggccccttctgtcccttagctctgcagtctctgccatttgttaagtctatgtgtgggtcagtccttgaggactccgttaggttcattaggacatttgtctactcttctgccaatcacacccagccttaactactgtagcttgagctagtccataaccacactggtccaggagtattttggttaatcttgggtctttatatttccatatccattttaaaatatcccatccagttctatgaaaaactccattttcctccctcattaatccttcctgtacttcagatatttcttttaagattattttctttttctcctaaatatttcctttagatttgagggggcttctttttatgataaattttcaccgttttgtgatctaaaaaatgtacttatttctaccttgtccttgaaagaatgttcatctgtgagtataattatgggatgtagttcttttctcttggcaacatgaaggttttttcctaccctcctctggcttttgggaagtcagttcccagtctccatgtgacaccccggtgggtaatcaatgtgtgggtgtgtgtatatgtgtatatatgtgtgagtgtgtatatatgtgtatatgtgcctgtctgcttttaagatctcttctttgacattggtattattactattcagcattttcgttattaagtatggatggatttattttcgtttatcctacttaagatttgctgtagtcgctgaatgtgatgtatcatgcgttccacaaattgcggaaaatgcctctgccaaggttgaccacctctctttccgtcatttcatccaaaaactccaattagataggtattagacctgttcactcaatcttccacatctcttaacctgatttcatttccttgcatttcttctcataatatcttcagatctgtattccagttcgctaattttccttttccttctgtctcctccgctcattaaatgcagccattaagagatgctattatgtagtggttgagaggtcgggttatggagacagactgctcgtctttgtattctagttctaagacatattagccatgtggctttagggcaattaatacctacctcataaaactgttaagaattaaatgaagtaatgtgtgaaaattcttgtaactgtgtctggcatagtagttagctataaattattttaactttagttttcagtttcaaatatatataaagttctaaatgttccttcaacccctttaacctttttctttttgataattttttcatgattttaattatttcctttttgtgtgatttctgactgggatctcatatttgtgggaactttacatagggtaaatccttgtggcctgagttatcaattcactccttcacagaagatttatgtttaaatttgtcaaagccctgaagatactaaaaatgtaaaacttgaaactataaaaaccctggaaaacaacctaggcaataccatcctggccataggcaccggcaaagatttcatggcaaagacaccataatcacaacaaaagcaataattgacaaacaggatctaattaaacttaagagcttctgcacagcaaaacaaaaacaaaaacttatcaacagagtaaatagcctacagactgagagaaaaattttgcaaactatacatctgacaaggtctaatatccagcatctataaggaacttaaacaaatttacaaaagaaaaacaatcccgttaaaaatcggcaaaagacatgaacagacacttcaaaagaagacatacatgcggccaataagcatatgaaaaaacagctcaatcatcactgctcattagagaaatgcaaatgaaaaccacaatgagataccatctcacaccagtcagaatggctattattaaaacgtcaaaaaataacagatgctggcgaggttgcagaggagaggaaatgcttgtacactgttggtgggagtataaatttgttcacccattgtggaaagcagtatgtcaattcctcaaagagctaaaaacagaatgatcatttgacccagcaatctggtatatacccagaggaatataaattatgctaccataaagacacatgcgcatgaatgttcactgcagcactattcacaataacaaagacatggaatcaacctgaatgcccatcaaagatagataggataaagaaaatgtggtacatgtacaccacagaatactatgcagccataaaaacaggacatcatgtcttttgcaggaacatggatggagctggaggctattatccttagagaactaatacagaaatagagaaccaaataccacatgtgctaacttataagtgggagccaagtgatgagaactcatgaacagaaagaagagaacaatagacactgggggtctacttgctggtggagggtgggaggaggaagaggaggagaaaaaataactattgggtactgggcttaatacctgggtgatgaaataatcatctgtacaacaaatgcctgtggcatgaatttacctatatagcaaactttcacatgtacccctgaacctgaaatataagttaaaaaagaaataaataaaaagttaaaagttaacaaataaaaccacattaaatcaaatatttcaggtcttggggtttttttaattgaattcaggctagaaacctatctgaacatttaggacttcaccttccctgatgcgtaagagccaatctcaaaaaggaaacacttcgctgttctgtgtttcagatttgttgttgttattttggtttgtagttcactttctcattgagatggtagcacttcaagaattttggggctgggtgtagtagctcacacctgtagtcctaacactttgagaggccaaggtgggagaatcatttgaggccagaagttccagacctgcctgggcaacaaagtgagacaaccaccccatctctacaaaataattttaaaaattagaaaagaagagtttggactttatccttatcttgtaagagcctataacacgcttttgattttgtgtgcaggcaggcattaaaattgaagctcctatttcctgggatgtgtagatgacccaagggcagttatgggccttagcactggtttacttctcttgattcattatttcattttacttctcagaatttgtattactgtttttgcaaactcaagtatgcattcaaagagatgttttaaaatgatttatctggcatttctgtatgctttataataagggagcatttaaaaatttctagtctgctgctttgctaaaagcaaaatatcataatgagtagatacccattcaaatatttgttgagtttttattgcatgttctcttcctcctccagcaattttctttcctgggacattttttttcctagttgtttttcctcattttcctcattgtggccactgatccctttagctggtttgctactttttctctatagactcattggcccctcctagagtatccttcatggtggattcaggtaatggcaggataatcagaattattgtaggcaactttcattaactgtatcacttctccacatgtggcagtctgctgcctatgaactggattagaacatgcttttcattatgtaatgcacatgcatatcacctagagatctccttaaaatgcagattctgcatttatactttgtagttaattattccaatatctaaagtatctgactttgctgttttctctttcttcccactctctcttgttctccttgctttgttctgtgctctgtgatttctgactgtgacctccggttcatgggaactttatgcaggctaaatctttgtggccagagttacggcttactcctccccagaagatctgtgtttacattcagtgggtttggagtggaccctgagattctaacaagcccccagttgatgctgatggactaggaatcacactttgcattgcaaggggtgttaaaacataagtatcaatcccaggaaaaggatcttcagtgaacggtggcattcctagctaaggaaatgggtgtcagaacctatctccacctccaactagaataagtagcatgatgtggtgaaaagtataaagatttggaagtcagacaaacatggactgagtatgtattacaactatttataaacatacatgctgcttctactccctggcaaaggagtgaactccactttttatcctttccaagttatgcatagccacgtgacttgttttggccacatagtgttgagctgatgtttctctttcttcagatggaatcattttcttgccagacagtacttatgacttaaagtggtcaccagaactgcagcatcaacatcacctgggagtgttagaaattcagatctcaggccaggcacggtggttcatgcctgtaatcccagcactttgggaggctgaggcgggcagatcacctgaggtcaggagatcgagaccagcctagccaacatggtgaaacactgtctctactaaaaatgcaaaaattagctgggcgtggtggcaggtgcctgtaatcccagttacttgggaggctgaagagagagaatcatttgaatccaggaggcggaggttgctgcagtgagccgagatcgcaccactgcactccagcctgggcaacagagtgagactctatcaaaaaaaagaagaaagaaagaaagaaagagagagagagagagggagggagggagggagggaggaaggaaggaaggaaattcagacctcagactccaaactcttgtatcagaagcttcatttgaaccagatcacaggtgacttacatgcatgataagtttaggaaggtctgctctagttcactcttcagttaccatggggaacttttataaaatagggatatatatttagggagtgcaaacgcagttttgttacatggatatattgcatagtggtgaaatagtgaacattgtatccaataggtaatttctcatccctcacccgccctcccaaccttctgagtcctcactgtctgtcatttcacaatctatatccatgtgttcacattgtttagttcccacttgtaagtgagaacacgcaatatttgactttctgttcctgagttagttcacttaagataatggcctccagctctatcagtgttgctgccacagatattatttcattctttcttatggctgaatagtattccattgtgtgtgtgtgtgtgtgtgtgtgtgtgtgtgtgtgtgtgtgtgtgtatcacattgtctttatcataccattcactggtggacacttaggttgattccatatctttgctattgtgatagcaaagataaatatatgaatataggtatcttttatgtataataatttgttttcctttgggtggttacccagaagtgggattattggatcaaatggtagttagttctttgagaattcttcatactacttgggaggctgaggcatgagaatcgcttgaacccgaaagttggaggttgcagtgagccaagatcgtgccactgcactccagcctgggcgacaaagtaagaattcattttaaaaaaaaaatcttgatactgttttccatagaggttgtactaatttacattcccaccaacagtgtataaaagattgcctttccttgcatactcagcaatatcgtcgtttcttgactttttatcagtagccaatctgactggtgtaagatgttatctcactgtggttttattttgcatttctctgatgattagtaatattgagcattttttcatgtttgttggctgcttgtatgccttcttttgagacatgtctgttcatgttctttgacaatacaatgttggtgggaatgtaaatattgagttgttgtaaagatgagtacatttccacaagctacatagacatataataggtagacatataagattcaacagatggcaattattgttggataaatggtcagcaccccgtgggttagtgataaaagaaaaactcacaaccatgtgtcagcaaaccacaacccatgtgccaaatctggcccactacttgtttatgtaaataaaggaaacagccacattcatttatctgtgtaccactcacacctgctttttcactacaacagcagggttggatagttgctgcagaagtcatatggcccactcagccaaaaatatttactttctgtgtcttttcagaaatgttagatgatctctgttctatagccgtgtcctagactaacatgaaaagacaaaggggatatctgtgatttagttgccacatgaatgtatggacacccttacgattgaagggaggtgaaacgtggtgtttgtcaaaggaaagatcagatgcagaactaagaggctaggacaccagtttcacaatgcccaggtctcatgttgggtcaaacttgatatggtgcttatacaaaatgaggatcggtacacagtatacttatatagttgcccagaaatgtgatacatggatttataataggagagaaaaaatccttctttagttatgtgctccttcccgtagaagtaaaaatcaagaaattgccatcaaccttatccttccagatggcaggcttctttataactgttctcttaacaaacatgattccattgttttcatactgtaaaagacacgggctctttaaaagaggcaccagcaggctgtaacagtaaaaagaacgaaaaagatatcttgaaagaactgcaagtaaaatatggcacaatttaaatggtgtagaagcaaagagcaataatcagaaacgagaaaattcatggtaagggacctgccttcgggctcatctctcccacaggcggctggacacctgctaggtcagcggagtcctccctgtgctcacagcttgtggccaaggaaagaatggcaagaatgccaaacctaacggtggataagatacagacatatgcagaaaaaaactggcagaaggggctaagttcttccctgcttcgtggactcaaatctgtctacaaggggaagcccagtgattagccaatttgtacgaacaatgcaagccaatttagatgtaatgttttctttctctctttcttttcttccttccttttcccatgctgttttctttctttctttctttctttctttctttctttctttctttctttctttctttctttcttttctttctttcttttctttctttcttttctttttttctcccttccttctttccttccttccttcttcctttcttctttctttctttcatctttcctccttcctttaattctttccttccttttcttctttacttctttccctccctccttccttccttcctcccttccttcgttcatccttccttcctttattccttacttctttcattcttttttctttcctccttccttttttctttgtccttaccttccttttttcgttctctgtttccttctttaccatcaaacacccatctctcgtttttagtgaaacattattgcaattttcttttggagaagcacacctcctatattgtgtgcagtactggtgaggatgtgactacaaatgccctttccacctcttgtcaaggaaggagcaatgaatgaccaatgctaggttagttggacgctgaactagagcactgcctcctgttatggctaagggcaggtggctggttctcactcactccagcagcggtatggatgtagcagagaaattattttttcccactgcatagattccctggagcctctgggtgccttttcaattcagtcctgaatttttaggtcttccttgaatttcatacactatgcccatttcttttgaatcatttcttttttctcttaggtcagttctgagtggttttattgcatgcaaccagtgatccctaactgatacacttaggcaccaaagtgctctgttttgctcttgatccaacaattctgtggtctctaaaatcagcgtttatagatagatggtggctgttacgctctgaattgtgccctctaaaattcatatattgaagccctaaatgccagtatatcagaatgtggctgtgtttggagttaggctctttagaggggtgactaaggtaaaatgaggcctttaggctgggccctgatctaataggactagtttctttataagaagagattaggacacagacacacccagagggacgatcatgtgaaaacagagagaagacggcatctacaagccaaggagagaggcttcaggagaagtgaactctatgaacaccttgcccttggatttttagcctctagaatggtaagaaaataaatgtgtatttttttaagctagtcagacagtggtactttgttatggcagccctagaaaacaaatacagtagccattctctttatctggtacagaagcagctttcttaatatattaagataggaattaccttgtgagaaatgctcaaaaggtaatgttactttactgcttaatgaatagtcctaactttactattgttgatgagcctatatattataatacactggaataagattgaatatatggataccatattagtgcagatgcagaaagtttcaaggctattgagaactctatgctgaaatgaaaataattcccaatgaggctgatatgttcacctttaactacttgttccttttccttaagaattttgtaatttttaaaatgcaaatgctctgggaaatggtgcatcttatcctgactacactagaaagcagaacctgaggagaggattatgtttagatgctttatgtgggaggtgcatcccagagcagaaaggctgagggaaaaaggaagtgacactaaggagaatgcaagacgatgtaatatttagtgcactggcgtctgctacacaacaaatcatataagaagatatatagcagatcaacaggtgcattcactcagccaggttagtagtctgcagacaggcagaacaaagaatccattggaagattacactgtagtgaggaaaggtgaaggaatttattggttgagttcccttctgccttctgtcttccactggtgacaacttacctcatggcacagacctctctttgtcatccagccccgttgacaactttagaagccaggaggaaccaaggactcgaggagatgaaatctcatggtcccatttccacgtgcaattgttcagcctctgcagtgattgaagtagaaggagttgatggttcaggagacagtgatgtcacaagaccctgaaaaggcacacaagatctgagagttacgtagcagtatttaaactagttatttatatttcaattgtgaatgtgattgattaaaagattttgtagtaaagcctaggagtcaggcttagaaaggttgcccatcacttttgaccatattctgtcacccagaaccttggcacacattacacagcctcggtggcttggtgcctggttggaaaaccaacagagtttggagaacacatagctgccttcctgcaacaccaaaatcacactgttattcttcttacctctgcactgtactgcacataatttgaattgtgcagaaaagagttcacagttgtgggatatattataaggtgtccaatacacaggtaatattctttcatatttatatgaaatgtgtccagtttatgccatcttatctaaaagagcttcaatggcattagaaagcatttaaaggagactactaaagatgatcaaagggatacattacaggcaggtagattaaagaactggagttgattagcccagattaaacaatgactgagcaagaagcaagagagcttttcaggtcaggatcacttgagcacctacattttaccttcctcttttcccttatttttcaattccaacaaaaaaagagcaaagaatgaacaactaaagatcgatttatttctggaaatacagcactagtgcttctcacatgcaaaatatagaaaagaaagagggaaagggacatttaaactacagttcacacttaaaaaagaaactcaccctagacataccccttatgaagcctagtccaagatatgaagtctggaatccagaggagactgagggtagacaatgcgggcggagaagaaaaaatgctcgtgtggcatcctctgtgaagtgggcaagggacaagcatcttcagagtgtgaccctagccctgaggtgcatgcacacctggtgtgtatgtcaggaggctgccaaagtcctggaaatggggcactgttgtgcaggctcctcagaaggtgtggtgttcattactgagggcactctattttccatccaactaccagcagccacaccaaacaaacaaataaacaaacatttcttcaccaaagaggctacagctgccctaaagtggatagcctccttctctgtactccccagggcccatggcattatttatagggagaagtgaagttgcaggaaacctaacgtttcttttgtttgcttgtatacatttcctatgtttctcaacccaggagccaaataagttttgcatccatgcatttcaacttccaaaacattcaaagacaaggcaaaacaaaacattaaactatgaaaggacatgaccgtgcagatgcatttaaagatccatcagaagtatcctcaagggtattgtcaataggatttgagagattatgaaacaagagtagtcatggaaaaagagcaaccacacatcacgaacatgtgagattaaatggaatggtttctgaatatttaaaattgcaattacagcagaaaagtgtggattggagactgagaaatgtgagttggaaaatgaaatgtagactaccctacaattcagttttttgaaaaataaagggaataaatggatgaacaaaaagacatgttgtagagggaagactggaaacacaacacgattataagagagcaaaggaaagtcaccagaagcagtaataaaccagagtcctctgagaaagggatttcagattttatggtcaaccaggcaaaattaaaagtatccatgtatcctggtgatttttttaaaaatcaacattaaagaaaagaaatcctataatttctctagcagaataaaagtatcacatgaagattgtacaaagtgggaagaataatcaggctgctcctttttaatagtaaattccacagcataatatagcaatcaatagaattatgagaacagatggttgtgacatagattcaatactcatttaagatactcatttataagagtgataaaaacattcttacaaaggaaggtagttataaagtttaacagccacatttttgtcctgaaggctacttaaataatctctgcaacttctggtggatccaaccactgcaacttcatggtagatccaaccactcattttttcaatcttaaacttcagtaataagatggggataaagaagatattgatccatagagattaagacacaaagacaagtcaatagctgatgaagggtgaatattaatatttttggaagctagaaagcatgtgggcatattgtaactcacatgaatggactgaagctgaaactcatcctaaagcagcatttgataacctccaaaggctcaaaatttagacataaagataactctctaagtaagcgtgcttagttggactaatggtaaggttgatcaaatgtctgtctataaagtaggtagatatctgaatcacctgatccgctctgtgattctggtgtaaatctaggaagtttgccctctggacactcagaaccaaaaatagtctggaatcaagatggtaatacaatgggacttaactgaaaatctacattttaaaaatagtgagtgcaattgtacatatatttgatcagttggagttgtctcagggctcattgatgttcttttctttattagatcccgtttttgtccatgtgtttcattttgcatagttcctattgctatattatcaaactcactgaacttttcttctgttatgtttctaattggctattagttctatctagtgtattttcatctcagacactacaatttccatctctgtaaattttatggggttgcttttatatcttctaagtctctgctttttgagcatatgaaatacatgtataataactatgtttaatgtctttttctgtgaattctaacttgtatgtcagtaagtttctatgggttagtttccattgattattctatcgttttattcttctttctggaaagtttcttctgatctatcttgtacgtgaatatgaacaaatgataaaactgacttaaagctattattgccatcattattattaatgcaaccttattttagtcatcaatattgaaataaggatttccatgatgtaagtaatagtacaagaaaatgtttgctgccataacatatatttaatttgttagaaaacatccatttctaccccaccttacatatagcaccctggaaggcatgtaacagctgaaaaataacttacgatttaattctcggcatgattatttctttgagagggatctgtttacttggatataacacagtgatcccttccattaattccctctggtctgcgtaagcattcttgtcttttaacatcttcaaagttttatttgattcacagaacaacattgctaaccttaaataatttcagcccaggacacagatctttaaaaataaatttaattttatcttgcaataaagaatatttgaacattgtaatcgaagagtattagaatttataaagccagatggtatatgtttaaattacccaaaaagtatcataagtattacatatcttttatatactttaagaggaaaagctcattcagattttttttttgcaatgaccaattccatttattttgataaactctacgaatggattctactttgaatcaatgtttgtacatatgaaaagacatcctacaggtattttatccattctcacctctcagcttacatcctgcaatgttttctttttctgagctccttcagtgacagtgtgtgtgggtttgtgtgtgtgagagacaatgctgagggcatgtcttttcatgccccagaaatacccacccattcttttatccaccgtcctgagggggacaccagtttctgctgacctcttgcggcttgcttgttccggaagctgtttattatgtttccaatctcctgccaccctttttcgttcaatctccacttcctggatcattttctccccacctcatacttcattttttctagtcctcctcttgtagcactgacaattttgatttataacgtatcttgcacgcccttctcttttccttgaactggtaatgtattttctttttcacccctattgcccatgtctctgcgtctagcttatttatttctcagtgccgaacacagccatcaaatcccttgtaatttaggctcggaggcttttcactcccaatctttaccatgactccattttttgtatttcatattttgttcttaaaactaaacgattccccagcatgcctgagcaccagccctggacaccccctccccacaacctcactcaaatttgcttctccagggttctgttacatcagtgcattcatttgggggattttcctgagtcccatttccaaccctaattaagtctgccttgctgctttcttctgttcagtctcatctccatagactgattttcagttccaagtgctccagatggagccatacacctgcactttggtggtggaaatgtaaaaatgtggcgtttgtggctctgagaatctggatgtcaaaatccaaaacgtgttttattgtaaaatgaaacagtcctctctctgccccaacccattccttgcttgtaaattctttaaagatttggacttgagattctcttttctttcctttcctacttctctgaagtgatgatgtaaataggcctcgttacacacgggagagtaacctgttatttctcctagataggttcccaggatttgctcccattttactctaattttctcccagttcatgccagctccttggttcccatcctgttctcatatctggatacactcccactactgtgtagaccagctccctgcaaacgtcatcaaactcaaatgttaaatatgaaggtgaatgaaacactgcttctcaaaactcttctagtacccactaaaatcattttgaaaaacaatgtccttctttgcttattttaaagttggcatctaaaatttttcatgtgctgaatgctggcaaaagacgtaattgcctgcatactctctctctctctctatatatataattattaattgtataatattttattatttatattttattttattaattatataatataattatttaatatatacttattgtatgttaaaatattaatataatatattaatattttaaatatatttaaatgaaaatattggacctgcagattcagatcattctatttacgaaatcctgactaattgaactcatacatatcccttaggacatttgctcttaaggtttagtgcctattcctagctacatgagtctagaaatagttgctgaattattattattattaattttgtaagtgtagccggcaatgcattattttgaaaaattattgttcaaagtccacagttgacattaacgttcactcttagtggtgtacattctatgggttttgactaatgtataatgacatgtagccatcattatagtgtcagacagagtagtttgactgccctaaacatcctctgtgctccacctattcatccactcttctctttccccaaactcctagcaagcactgatctttttattgtccccatagttttgccttttccagaatgtggtctagctggaatcatagtctgtagcctattcagactggcttctttcacttagtaatatgtgcttaatgttcctccatgtcttttcatggcttgacaactcatttattttgagcactgaatgatattccattgtattcattcacctactggatgatatcttcattgttccttaagttttggtgattatgaataaagcggtagtaaacatctgtgttcaggtttttttgtttttttttttcaattgcaagatttaatagagtgaaaacagagctcccatacaaagggagggaacccaaagagggttgccgttgccagcttgaatgcctgggtttatatcccgatcattggccctcccgctgtgctctcaggcgatagatgattggctatttctttacctcctgtttttgcctaattagcattttagtgagctctctttactacctgactggtcgggtgtgagctaagttacaagccccatgtttaaatatgaatgcagtcaccttcccagctagacttagggattcttagtcggcctaggaaatccagctagtcctgtctctcagatccccctctcaacaggaaaacccaagtgctgttggggaggttggccaactaccgctctaactgcttcctgccgaattggggcatagtaggggttgtgcagttgagatttcctcgggagggatgctttcgatgtcattaacatcggagcatgggctagcagactggtccaggggtccgcggtagatcttagtcatggactgcatctggggctccatttgaagaaccatttgtagctttacagctttgattctgaaagagacaaacttaacaaggaggttaaagatacagggtccaaagaggagtaacaatattatagctggtagaggtcctaagaagggagaatccagggcatccattggctgaggaagccccagggtccggtgttttgaagctcctctgctctatgttgtattcgatctcgaatttctttaactttctcggtgacgatttcggattgattaacataataacagcattcttcccctaaaaataaacaggttccccctctttcggaggttagcaagtctaaagctcttcgattttgaaggaccactgctgctagggagttaaattgatcttgcaaggtgaccagggagtcagcgacctgttccatgtcaccatttagttcttgagatagtttgtagtagaactgagtagaggttgtgaggccatcaatgtcagtacctagtctgcctagcactcctgctccaacaacaaaaggaagaatgggtactcttttgttgccgggcttaggtgtgacataattgtgtaaatcttgttcagtgtaaatggtcatagggacagtaagaatgagaggacgcacatagattctgaatggccattcaaacaacgatagtctgaggtaccacagacaaaaaaatattcctgagggtaggcagactatttgtgtgggaggagttacccacctgatacattgggagttggttgtgtctatagtattgttaaattgtacacaggtaaggtttgaggtatgggttatctccagattggaaacaagaggtcctactaaaacggaagtggtgtttatttttgtgctggagttgttccattgttcaggtacagggattgaatgtatggcctgaagtgcagtgggaggcacatccaacagttagtagggttttgggccgaaaccttatggagcctagtgagggtagtattaaataagcttaccagccgattatgggtatggagggtttcatgtagttttgagagatctagtcctttgtaggggctgggggtactttgtacccaggtcagttgggagattatttcctttatgtgtttttctcttgcctgatcttgaactccacccccatcagacataccattatgggtgaagtaagtccaacagactggctccaagtcctccaggacaactaggattaatcattttccctgtccaataatgagtatttgcatgcatgcaaagagttgcagagttataaccactcttgtggggcatatgggtgtgggccatgaaggtgggatttcctttagatatactcctatacgatgggacatcaatatttccgggaagccgcattcttcaggaaactcttggtaaggggagctactggttgtacagcagcatggagggggtgcagtgagagtgaaaggggatactgcctttggtagggaaaggaggcagaatcctttagtttaacttgaacaggacgggcattctttgctcatccatatgtccttctgttgcctagacttcaggattaattccttcctcaagcaggggacaacaaacgggtgttccttctcctatgttcaggtgtataatgactcctgcttttactagaatgtctctccctaacaagggaatggggctttcaggcataattagaaaagcatgtgaaaagagtaaagttccccagtcacaacttagtggctgggagaagtatctagtgactggctgccctaggaccccttggatagtgacagatctggaggacagttgtccgggacaggagagtaagactgagaagtccgcgccagtgtccaggagacagttaacctcctggccctcaatggtcaagcatacctggggctctgtgagggtgacggcatgggctggcgcttgccctgggcaccctcagtcctgctgctggatcatctggttagtggcttctgactcagaggaccttcgtcccctgaggcagttggccttccagtgattcccttgacataaggggcatggacgagggggcagcttatttccacttggagaatcttttttaaagtgtccttttagactgcactggaagcaagccctattaggcaatcgatttgcccagctattcccttttccagagcctccaaagtccgcttgcctgaggtccatgactaaagtggtggcccttttttttaaacccgtttatcccattctgcctgctcctgctgatctctattataaaaaactgaggttgccaagttcaatagggtttctaagttttgctctgggcctaaggcagacttttgaagaatacccattgtgattttttcctcaatcacctgggaggaaacatctattgtcctgtcctgaagggagttcctcctaggtctggtcagacctttatatggtaattaagatttaaatcccctgtaaggaaatctgctgggttaagggaattatcagtggttagagttaaattacctttttctaaaagaatagccccatactttaagatttttgagttagtaagctaccttttttgacttagaataattctaaactggtgaggtgtgctcacaaagaggtttcctctaaaagttatttttctactttcttccattagcaaagcagttgccgctacagattgaatgcatctgttggttactgggttaaggatttttgataggaaagctacggattgtcagtggtctccgtgttttcaggctacgcccttgtttacgctgacaacaaggtagtattggagtgttacagggtcacagagaagaccctcaattatcaattataggtttaaatttaccctggcttttaaaggaatagggcacactgtttttttactatttctctgtctttctttctctctttgactccctctctctcctctctgtctccctgtctccctgtctctcctctctgtctccctgtctctcctctctgtctccctgtctctcctctctgtctctctctctcctctctgtctacctcctctctgtctctctatctcctctctgtctctcgctctctcctctttgtctctctctctctctcctctctgtctctctctcctctgtctctctctctctcctctctgtctctctcctctctgtctctctcccctcttctcttagccattactaacgtggggccctggcaaatgtggtggggaatgggtcccacataactgccaatgtcgagagctgtatgcctaaattgggagggacaccagggacaagactccctgggtttatagcctagatgcctaaggacgcggggtagagctttcttaaatccctttggagatacaacttgctagaggaaatgaaagtctgaaccattagtacctaggaggcagggatcagaggaagtagattcagaggtaaggagaattttggggtgacactttcaagaaagtcatggtcaggatccaagaggtatgagtcagaaggaaaggtaggggcgcacgcatgggcgactattgaatagagacttctggctgcgccatgaactcaaccggctaatgccgggagtttgggatgacagctttctgcctgtagtcggccctcggcttccccgagaaaattgaaagtggaagctggttctgggcaggccaacattcccaacccacaagggttgggggttgttagaaagcccttccccggacagcctcacatctaagtcttaagtccagtggccacgctaatcgtttttaactggccgacaggtgcctggtattttcctgcaattctaaggaaggataggacggaatagcaagcgaaagtggtccaatattactcaccgctttggaggtcccttcgtggtcaccaaaatgtcaccggggggtccttgctcccagagatcccaagatggtggcgggcagcatccaagatggcggaaggccgcttccaagatggtggcaagccttgtgttctctgacctggggttcttggcctcacagattccaaggaatggaatcttgggccatgtggtgagtgttatagctctattagaagccatgggtcacggaagacaactgtggaacccagtgactagtgttcacctcaattaggacgaacctgggcacttagccatgcaagaacaatggcaagcctttagaatgatcgggagcagcaatgggtgccttgctggatcagtagcacagcagacaccctgccggatccagagggatggaagtcagcagtgggtctgcgatggcagcaaacagcagtggtggacagcgagcgaaagctcagcttgagccatagcaaacacagaccagaagagagtacagttgcaagatttaatagagtgaaaacagagctcccacacaaagggaggggacctaaagagggtagcccacaggtttttatgtgggtgtaagttttctactcatttgggtaaataccaacaaatatgtttgctggattgtatggtttactttcataaggaaatgctaaacttccaaagtgactatgccattttgcattctgtttgatgtttcgtacacttttatcttcacaacctccaatggcatctggcacacagaggatactaatcaatatttgttcattactgaatgacaagaagcacctgggcagtgtatttaaaatgtgaattccccagctaaatccctagagattctgactcagtatgtctggagtgggtcctcgggatccgcctgttcagtcagcacccggggaatgctaatgtgcatggtctggaaaccacagtttgagaaacactggaagctcattctggcaaacttctctgtgtggccatgtcagacagggtggtcttggccacttctgaaaaatggcagttcttaattctcactatttctgtgtccctgtgctctatatggttactaggttgtctttaaaataaaaaaggcttccataatgggaggtgaaattgctttttattccaaaaaagatttagttgaatgaaagtcaatgaatgtaaatgtaaattcagaacagagaacattggataagtatgcaagacaatgaggttggaagggatatatttttcaagcataacatagacacttaaactctacagaaatattcaaataccttcccgcaacaaattcaaaacttgtacagataaaagccacaggaagaataccctaaaacaaggcagtctcttacataaccacagtgcaatgatcaaaatcaggaacttcattgatacaatgctaggatgtaatctagggaccgattcagatgctaccaattgtgagactgtccaaaagcatgcttcagttgtcctgtttattgaatctcttttaatccagggcagttcttgagtcttgttatggcatgagcactacccaactcttttgtaggacgtcattaattagggcttttctgatgtcactttatgaccagtttcaagttatgttattttaaaaaatgtttaagtttaaaagcaatgtatttatcatttagcttaaggtggatggctcaaggtggtggaaagtggatggctaaaaagtgttggaaaggtttcaagatgaaattctgattttctataagatgaaagattttggtgagaaataaaagaaatctgtaggtcacgggtctttcttcacattaccactctcctaagctgagagaatagagtctgacatagttgaatctttttgttttttaactttcatcctctcttttttgctttccttttccccatgttactaagatattggggaaaccaagtgatttctcctatagaatgtccacactgtagaatttatagaatgcttgttcctgctgtagtttttaaatggaattccctgcaatataaaaaatagtactctggtgatagagatgtcaaatcctgggcccaattctagcacagttacttaagcaaatgttttgtaagcctttagcaaaaattaagaggcacttgccaaaagtcagcatgggttttctaagtacacattttgcagggttcttcacacttccttttcttgatgcaaggctggtagtcttgactaaagtgtttagtcatgttaaatctgtatttcaaaaaaatgattggcaaaacctttttatttttaaggatagaatttgccgtctttcagacacctctcctatgtcaagaacttcatgaatgccaactggaattctctcatgatcctacaaatcagaatttagaagtcaggcagatttacattcaactcttaactttccctctttctagctatgagaactcagatgtgtgaactaacctctttaagtctcagtttccttattggtaagatagtgataattataagacctgttttatataatgtgtaaaaattaaatattgtgaaaattaaatgcaggtaaaaattttaatatagtgctttgcatatagtaagttctcaatagctgtttgctattagttatcagtgcttccatggcacagataagaagactgagggtccaagaggctaactctctggaataaagtctctcagctccaaatttgggaaccatcatcatttccataatatcttgctgcctccttgtggacaagccaaaagaaaatgtgagctgaaaagccatgtaattctacagatttgtttcaagttcaataaccttcaaaggttctaaaaaaaaattaatgccaaaggtagtgtatgatgtctgtaatagactgggtctttattgccatctcatctgtgtggaaatggggctaaaatgaagagatgtttttcagatggcaaatgaaaataaacaactgcagataatgctataagtgggttagcatttttttaatgaatagattaaaataaaaacaaatttaaatgatgagatttaattcacaataaatgcaaatttctgaacttggtctcagaaataacaactttacaaatcccagataagttatttttagatcttgagcttgctgtgaaatgtaaaaagggattttggtttaactgtttgaatccctccctgtcggcccttcagtgaattatttagtccatagtaagagagatgatggattctccaagtggcgggtcccaagctcagagattccagaacagtggatgacactgaggaactctgcctttgtcactatggcacagcattgaacaaaaaccatgccccctcaaagtttgtgctgtgttgcaaccagctgaagataaatcagaaaataggatctgatgttgttttgtagagatctccttgtcctggggcttattgaggcaattccatgatcatgaagtagaacaatgcatacagcccatccagaagagaaccagaggactccaacttctccatggaagccccagaaagctgcttctgagtgctcctctccttcctccccatccggacgtcaaaagaaccagtactagacccgataagcctaccttggttgtcacgggggtggtttgtgtggtgacaaatgagactgtccgagcaactgaaggtgactgtttatggaattacatggagatgttgttatgggaacacatattcagccccttctataatgggccgaattgtgtcctcccaaattcatacgctgagtcttaaccctcaggacctcagaatgtggctatatttggatatggaacctctaaagaggtaattaaggtacaatgaggtcatatgggtggaccctagtcctatccgactggggtgttctcagaagagatcaggacacagacacacacaaagggacaaccatgtgaggacacagagggaagacagcatctacaccaaggagggaagcttcaggaggaaccagcgctgagacaccttgacctcagacttgcaaccttcagaatgtgagagaattaaatctctgtcgttgaagccctgcagcctattgtactttgttacagcatccctggccgactaatacaacttcttacaaggcagctcattttaacataaaaaatttttgtgttgaaatcccaacatactgaggcacatcgacacatgagctgatctgctgatagttcactgtgccaaatagacaaaaccagggagctgttgttgaacctatggggctagcaggaaggtgaggattacaagagtctggattctggactctcacctcctccttcttttccccacacctacaatccctgaggattctttgcaagacaaagtgtggaaatcactgagctagcacaggtacctgcaaaccagaggccactggaagccacactggcccttcattttgaagaaggcccattgcaacccactctattgatttcagggtcctctctggtttatggttcacatttggaaaacttcttgtaaaattagcttattacaagagcatacatgcctcaaaaatttccagcattctccaagacagacagcactgtgtgttttcacataccagaattttcatcatggaaggtgctcagtgatgagtggaacctctctgagaaccagttttgaggttctgggagcccaaccacatggggtattctattcatgaagctgtggcattcctcatgcagatgagttcagatacctgatcaccttttcctatacatcattaaacttggatctgtgtggcaatggactagatgcagtggtatcttcagtcatgctaggatatccttaggatagctactgccctttgctgctgggttgagatgtgcttcataactgtaccctgcccagcccctgccaccctggcccactcataaatattctcacatggggtctgtgatattctgaatatacacatatatatgatacacacacatacagaaacacacatacacatatatgtgtgtgttttatgcaagcttcattacataggcctgattgagaacaagtagaaatgtgattggacaaaacacacacacacacacacagatgcacacacacacacatataggtttttggccacggtttccaactcatatctcccataacccttattgcagtcttttgttagaatgttggggcactttaggtctcagaaaacagaacctctctctctcactgaatttctcccttcttcttttcacctgcccatggcaagattgtaatctgattgtggatcaaaagaccctcattctagacagcgttctgccccatactttagagggaggaatgctacccggagaggccaagaaaagtctgaatagactccttgctgggtttagatcatggttttttttggtccagttgcatttgtacacagttgtcaatcatgtctataaaatgaagtcttcatagaacgccaggaggactgggttcagagaacttctgggtggctgaaaatgtggaggtccctggagggtgattcccagggagggcatggaagctccacactcctttgcccataccttgccttacatgcctcttcatttgtgtcctttgtaatagtctttataataaaccataaatatgttttcatgagttctgtgagccactctagcaaattaatggaaccgaaagaggggactgtgggaaccccaacttgaagctggtcattccaaagttcaggaggcctggacttgcaactggtgtctcagggtagatccctgtaggatctgacactatatccagaaagatagtgtccaaatttaattagaggatacccagctggtgttcactgcttggtatttgatatggtttggctgcatccccacccaaatctcatcttgaattatagctcccataattcccacatgccatgggagggacccagtgcgaggtaattgaatcatgggggcaggtctttcccatgctgttttcgtgatagtgaataagtctcactagatctgatggttttataatgggcagttcccctgcacactctctcttgcctgccatcatgtaagctgtgcctttctcctcttttgccttctaccatgattgtgaggcctccccaggcatgtggaactgtgagtccattaaacctttacaaattatccagtctcgggtatgtctttattagcagtgtgggaacagactaatacactatgcatggggaaaacccccacattttgtcccagaagtcttctttgttgattgttgcagtttgagagcagagggaaaacatggtttgagagtttttgctaaacagggtcccctcactccatgatgagcagttacccactaaatatttttccctcggtcacatgaaagtaagagtgtgctgtgagtggatccctggaaatcctcccaaaactcatcctgggatcacatcctaactctctgctgtcacactggatggacaatttttatgaaagtaatggcagccctgagttcatggcaaaataacacattactgtggaaggacagaggaagctgactccataatagctattcttaggtgtggccgcttggaaagagagacaggaaatcatacagagattacggagattgcttcctggcagtggccctataattagccttgcagaagaatcccttccagtcttttgggtataacagagacatccaagtacttgcactgcatgctcactgctgaacttcatcttctatcaaggctgttcgagaatgccattttcgttttccttgctgtcaaagagctcaaatgcctgtgcccttccctcgctaggaacacgcatcgctttaaatgaaagctgcaattaactccagaagagtgcaggatggggattagggtgaagagagagggagagaaatatcagctttcagattttgcctttgtgataactatcttgtttatcttttagatgattgtgaaaaactgaaattatggaaggagacaaattactatttatgctccagggaaattcaaaaaattctggaaatgcatacttaataagaaacaaatctatacatttataagttttatctctttgaattccaatgactaaaattgttacttttaaattttgttccatttatatctagacttgagtattttttccctaggcagatagctgctgaaaaaagaaagatggttatgagacagttatttgtttaatttgcaatgttttcttaggtactgctatgttacattttataaatgacttggggatacacacacacatatacacacatctctccatatttatttaaaaatctgtctagcattaatgcaaaagataaagtatataagggaaaacaagttataaacttgttttaaattacaggaaggctgtaattcaattcactctttgaagcattttgaaaggatatcataagacgtgtcaatacattgcaattaaattgtttcactgtataattcatttgcactatgaaatctctgctgtttccttaattgatgcatcttatatccatttaaaatatacattaattacttttatttatatttgaattgccactgactgtatttggatttttatttccctaagtggaaattgagctttccattaaaacaaccaaaatcattttttttgtgccgataatttcatgcagtgatgaatcacctagacttcactttatctgtagctgtggaagattaaggtggtcacaaattcttttcagttcctctctccaagaaaggaaatctattttcctaccctttaaattggagctggcctccacatttgatttcaccaataaaatacaacaaagtaatagtgttaaagtgccaaatctggacttcaagaagccctgtagcttccacttcctctgtttaaacagtggtatgtgaacatgcctgggctagcctcctggagaaagtgaaaccacatggaacagaggtacagccatcttagctgtcccagctttcctaggtgaggccccatccacatgactgaacccagagatagcacaagcaatagagatgagctatcctagctgagctctgctgaaattagcaaactgtagtatcatgcattaaataaacaactgttgtgtaagccactgtattagtctgttttcacactgctaataaaaatatacctaagacttggtaatttataaaagaggtttaattgactcacagttcagcatgactgcagaggcctcaggaaacttacaatcatggccgaagggaagcaaacatgtccttcttcacatggcagcaacaaggagaagaatgagagctgagccaacagtgaagccccttataaaaccatcagatctcatgagaacttactcactattacaagaatagcatgggggacaccaccccagtgattcaattacctcccacagggtccctcccatgacatgtggggattatgggaactacaattcaagatgggatttgggtggagacacaaccaaaccatatcagccactatattttgacttaattacaaaatatatcagtgcaaaggctgataaaagataatacaaacctaatacaaacctaagctaatgtagaaactgcaattatgtgccaatatataccttgttctttttagacaaaaaaaaaagccaaaattataattttttatatgtgataaaagcaaaaaagtttattggacaaacagattgtctcctagagccagtttttaagagggatttgtctcataaaaagttcatatagcagctgtattaaagaaaatgcaaaagttattttttatgtctgattttggctgggcatgatagctcaggtttataatctcggcactttgggagtcgggagtgggaggattgtttgagcgcaggagtttgaaaatgtagtgagctatgatagaaccactgcactccagcctgggcaacagagaaagaccctgaaaagaagtagtcagagaaagctggagttacagaaagccagtctaatgtgaaatgggtgagtatttctggggaaatattttgataagggaaccaagctcagaaaacgtaaacagtttgtatgattactatgccacttgcactattttttcctatatatccattattcccatggtgcttttgttggagtttgtggtaataaattcagtattgcacagtttgtccataaatacctttaatagagttattctaatggtgatggtgttggtgttctgcaattgaaagaagaatcctgatttacacgtgttaagatagaaagtcattcctgactttgtacacacacacatgcacagacatactttttatcaatatttatttcatgaaacgttaaatgttcaatgctgtaagcaattattcatttgagactttttatttctgtgacttagggcaagaagatactattttggctcagacaatattgtgtgtgggttacccgttgatcattttaaatatgaaagaataactgcatagtgtttgggcagttccagttttgaacatcatggcctccctaaggacctgccaagatgaattagatgtgaactgcacctcgagtagcatgcactcatgttgaattaaacagcaaaaagcatctactctaaacaaagcttgtagtgtgtaaatagctgtcacagacctgcttttgctaatgatgatttgacatgaaattcccgtgttcctggaggaagggagattgcattagtgccctgatttctcagcctttcctgaaaccaggcccttcacaatgtgaccacattacagcttctctcaacagaaggcaggggatagttcacccctaaattttgagttcacctcattacttggtttagccaatgggtgtcaacagtggcagagattttgaaagtgcttgtgctttctcttgtgctcctgctgttggcccccatctttagatcatgcctgagctagcttgctggaagctagagacctatggtgcaattatctcagctgatagccataggagtgaagtcaacagggaaccaaaataccatctagctgaacacaacctaaatatgcaacccataatccatctcacgagttagacaactgcattttatttcaagccatcaaggtaaggtaaagagtgtttgttatgctgcattattgtagctctagataaccaatcttttcttaagcatacccttgtttgattgagaatagttgtccctcagtatctagaggggattggtttcaggacccccatggattccaaaacttgagaatactcaaggcctttatataaaacatcatagtatttgcatttaacctaaatacatcctcatatatgcagtcagccacacgttctacatctgtggattcaaccaatattggatccaaatatttggaaaaatcaagtacatctgtagtgaacgataaacacctatttttcttgtaaatagtaacaactatttatgtagcatttacattagattaggtattatgtgtataattatgtaccacctaacaatgttttggtcaacaacagatcacatatatgctgctggtctcataagattataatgccatatttttactgtaccttttctatgtttagctatgttcagagacacaaacacttaccattgtgttataataccctacagtagtgagtgcagtaacatgctgtccaggtttgaagcccaggagcaagaggctatgatgtatagcctaggtgtgtagcaggctataccatctaggtttgtgtaagtacacttactgatattcacacagtaacaaaatcatttaatgacacatttctcatgaggattaagctctgatattttatcttgcccaaattcccatctaaggagtctgggtagtcatgctttacaaaatataaattctcatcagatgggttttattttaccctatatattgtgacctacgttccaataagactctgtcataacattatgtgacaaagaagaaagttaaaatattttacccccaagcatgtttctttgctatatcttgaaatggccctgcaaatttgtcctttgtgggggaaaatttgcatctgtaaagaatgtctattaacatagctagatcttttcttccaggcactcccaattctgaagagatttactaagagtctggcaccttttaaaggtctgaataggaaacatttgtcgtctattgtctctaaaggctgccactataagacttcaaaagaaccttggtctccacgatcttttatcttaacctgaacatttcctttctatcaatcccaggtctttagacaaactcaaccaattgtcaaccagaaaatgtttaaatttacttacagcctggaagctccctgcttttctggttgacaattacaataacacattgattaacaacagggctatgttctgagtgtcgacaaaaagagtcaaactctgtaaaatatttgaagagatttattctgagccaaatatgagtgaccatggcccatgacacagccctcggaaggtcctgaggacatgtgcccaaggcgatgggggcgcaacttggttttatacattttagggaggcatgagacatcaatcaagtacgtttaagaaatacataaaggcgagacaactcaaagtgggtggggacattgcctgtaaaattaaatggcaacatggcatgcctaacttgggagccaaggagccccccagtgaaatcctagcacaattacttatcagttttagatggttgtagaagatccttaaattctataagcatcagctttctcataaaaaatggagctattaatattacttccatgagagtgttgctcggagaattattaaattcaatggtatattcagaatgcttagcagagcacctggcagatatttaactgttcaataaattatagttattattattaagactgcttactcctcatagaaacctgaaaatttgggagaagcagtttattgagaagaaaattaacttagaattttgatgagcgatgcagaaaagtaatgaattgccatatttgtgacacagagagttacctctttttgaaaatggggcagattatttttattatttcatcctgagggacccatgcccagggaatcagacgaagcacagcaaggattgaggtctctcatttgaaacaggatgtaaacacatctgtggaacaaagatcacccagggcagtttttaactatgttgattaatcatacaaattataatggatggtacaaacaaaaattgctgatgcttccaaaatcattaatgatttctgtagtcacgtaaagactttgggaactattaaaccaccaacttttgtatccttttcattccaattccaatgataaaaataattgcacattagggaaaattcggacaatatagaaaagtaaaaacaagaaaaaaaatggaaatctctcttttcagagcataaatgtttcagtgtattttctcccaatctttcttcttcttgacatttaaaggagaaccataaactacgttgaaaattattttatagaaactcaagatttttacttttctttctgcaaagaaaacgtgttatttcattgtctgtgtcagaggatcttgaacaatgaactctcagattccaaacaaaacatttcaataaaataccaaacttactgtttgcacccttagaattgctataatagacctcgacatttttgaatccttgttctactgaaaggtgagaggaaaatgcgcacagttgtctgacataaacaagattgtattaaacagccctgtattagtaggttgaaagtatgctgatgaaatgaaactaacacaatgtgttgaaataagaaagaaaagtacactttctaaagcacaactctaaaatttgctttggtttttagtttatggacactccgacatcttttcttttttagggtgttcaaaaatgacctcagaatgcttcatgtgagctcaatcatgaataattgtggtaggagtttattggatggtctgatacccattctaattaagcacgtaaaagtacactgggttcctcaaaattatatccagagccatcacaggttatggatccaacaggaggtttgatgaaatacacactgctcctagctgagaaggctgttgaaaacccacatgaacaattgcacttataggatttaagattgactcagggcaccctggtttgaagaggatgacctgagttgaagtgaattcttaagaccccataaatacaatgttttgtcgggggctgatataacccaattcatgcctgatgctcctggatctctagtctgatttccaccctgccaacccttccagtagccagctctcagtgtgcacatgtgcttaagtggttcttagcctctcaataaacagcccaggacagtaagggccaaacaaaccttcaagtatgtaaaggaaattgcaagtgaaccattcctgcagcccaagatctaagccctattaagaaaatagatgcctatttatcatcttcattcatgtgccttgcaggggcaaagaaatgactaaagacaatcttgcaatgtatgtgccaaagacatgcatttccctttggattatctgtggagttaatttccaaagatgcaacagaacataacagagcaatggatcagtgcctggcagatccataagtcttacactaaatgcatgactggtagtctgccagatgacagaggaattcttcttcataccattgccctagctctgattttcaaacagatattaaaaatacagaggggagattctcaaatcacaagctttcaaagttaacatcgaaagaagccataatcatcacatttgttactagacgatacctcattttcaccatgtattagttaagcacttaattggctccccaatgctttgctagcaacatatcacaattgtgaaacttcataacgagtgtccactcaatatatttaaatttcgttttttatgacttcagctaggtggatgactgacttgctagacaaatatataaaagcatattaaaattatgcataggtagcagtggcttaataggatttctcctacatttcagtatttcactgaaacatgctttattttcacagtatgctggctgttaagtgcaggcacatgaatgaaaaaggaatttgaccatctccctatctacaaatgttattgtttctacagctgtctcctccatttctgtgtcaggctcaacctaaaagaaaaattttaatgtgaatgaaagtctgcacccgggctctgagaaagtgtgtggaagaagatggtaggtgtgctcatggtagcatgtacgtcgtaggtcataaacaatgaagcacctgtcctttacaaatatgaaagctcacagttattcatgttactcagactctttgtccaggtttcagttcttttctttgccctgcaatgtaaaagtaatcacaactaaataggaaatatggatctccaatccacaagatgaggtgattaggaactgttgtttgggaagcattggaacaggtggagatgattagtctagaaaagacacatcttgctgttgaaatatttgaaattcacgtaagacagtaaaagaactcctgttgcattccaggggacagagctagatctcatagataaaagccacaaggagacagaggtaagaaaaacataaatatatgctaaataggagaattctacatatggcactattttcagaaagagcattaatacaatctctatttatattcagacaattatcctagaatattatagtttttttcataattgtgtgtctactgtataccacctaggaaatattaaatactatgatcagtatttttgttattgctacttttatttttattattaattgggagcttttccagacattaataaacccttagcagacataggtcatacatcagttgctcaattcattgtcacctctatgagcatatttctgatagtgaagctcagtatgtgttgtgtaataaataaaaaggaaacaatgaaagcaaattactcattattgccttatggttaaataaagattaaaaaacattggaaaccatgtagagaaagcagggtataattatattagaaaccactgtgtaaccatcactaatattaaggaatacatctagtcctgacagctccttgtaaatggaaggagacatgttgccaacttatactatctactggaaaaggtagacattggcaaagctgtcaactgtctcacaagagaagccaaggggcttctacaggtatcctccagagatattgtgggttccgttccagaccaccacaataaagaaaatatcacaataaaagcaagtcacacaatttttttttatttcccagtgagtataacagttatgttcacattgtactgtagtccgttaagtacgtaataccattgtgtctaaaaaaatatacacatacctaaattgaaatactttattactaaaaaatgttaacaatcatctgagccatcaatgatttgtaatctttttgctggtgaagggtcttgccttagtgttgatggttgcagattgactaggatggtggttgctggaggtggggatagctgtggcaatttcctaaaataagacaacaatgaaatttgctgcattggttgacacttcctttcataaaagatttctctgtagcatgagaggctgtttgtagcattttacccacaagtagaacttcttttaaaattggagtcaatcctctaaaaccctgccacttctttatcaattaagtttatgcaatattctagatttttttgttatttcaacagtgttcaccagtatattatatattatattatgttataatcttcaccagtatattccttctcaagaaataattttctttgctcattcacaaaaagcaactcctcatccattcaagtttagtcatgaggttgtagccattcagccacatcttcaggctccgcctctccttctactactcttactatttctcccacatctgcagttacttcctccgctgaagtcttgaacccctcaaagtcatccatgaggcttggaatcaacatctcccaagctcctattaatgttgatattttaacctcctcccacaaatcataaatgttcttaatggcgtctggaatggtaaatcctttccaaaaggttttcaattaactttgcccagatccatcagaggaatcactatttatggcaactgtaaattatgaaatgtatctcttaaataataagacttgaacgtcaaaatgactccttgatccaggggctgcagaatgaatcttgcgctaagaagcacaaaaagaacactaatctctttatacatctccatgagagctcttgggtgaccagattaattgtcaatgaacagtaaatgttgaaaagaatccttttcctgagcagtaggtatcaatagtggcctcaaaatattcagtaaaccatgccttaaatagatgtgctgttatccaggctttgttgttccatttctagagcacaggcagagaagatttagtatcattcttaagggccctaggatttttggaatgctaaatgagcattggcttcaacttaaagtcaccagctgcattagcctctaacaaaagttatcttgttctttgaagctttgaagccagacattgacttctcctcttcagctacgcaagtcttagatggcaacttatttcaacattaggcagtttgatttacattgaaaatatgttgtatagtgtagccaccttcattaataaccttagctaggtcttctggataacttgctgcagcttctagatcagcacttgctgcttcactttgcactcttatgttatagaggtggcttcttttcttaatcttcatgaaccaacctacactggcttccaacttttcttctgcagctttctcacctctctcagccttcatagaattgaaaagagatagggccttgctctggattaggctttagcttaagagagtattgtggctggtttgatcctttattcagaccactggaactttctgcatattagcaataaagctgtttcactttcttagcattcatgtgttcactgaagtagcacttttaatttccttcaagaatttttcctttgcattcaccacttggctaactgttttgtgcaaaagcctagcttctgccctcttggcttttgacatgccttcttcatgatcatttcttgcttgtgatttaaagggagagactctgcctttcacttgagcacttggcctttgtaggggattaattggcctaatttcaatattgctgtgtctcagggaatagggaggctcaaagagagacagagatggggaatggccagttggtggagcagtcagaacacacacaacatttatcaattaagtttgccatcttataagggtgtgatatgtggcaccccaacacaattacaatagtaataacaaacataactgatcacagatcaccaagacaagtatagcaataataagaaatacaataataatgaaaaactttgtgagaaataccaaaatatgacatagggacacaaagtgagcacatgctgttggagaaattatgtatagctttgctcaatgcagggttgccataaaccttcaattcagtaaaaaaatgcaatttctgtgaggcacaacaaagcaagataggcctgtgtttagatgagcactggaaaccaagaagttcccaaataacatttaaaacacagaggcttagggttacagatgtgtgtcattttaatcttcctttagtaaaattatttattgtatagaatgattttctttaaataattacatgccctagagaaattacaatttgataaacaaatttttggattttttttttgttataggtaagctggtctacagaccacactgggtatgggtaagctagtctataggctacactatgtatgagtaagctacactatacaatacactggatatgtgtaatctagactataggttacactggtgatgggtaagctactctacagacagcactgggtgtgggtaagctagtctatagggtatactgggtatgagtaaactagtctatagactacactgagtatgggtaagctagtctatagactactttgggtatggaaaagctagcctattggctatgctgggtatgggtaagctagtctatagactacactgagtatgggtaagctggtctataaactacactgggtttgggtaagctagtctatagactaaactggatataggcagtctattatatacgttatactttatatgggtaaactagtctatagactacagtggatatgggtaatctagtctataggctatatttgttttgggtaagtcagtctatagactacagaggatatggataatctagtctacatactaaattgggtgctagtaagcaggtctatagactccactgtgtagagatagggtaagctagtctatagactacactaggtatgggtaggccagtctatagactgcactgggtactagtaagcttgtctatggactcctatcagggatgcctccagatatggaaacatgcataatgaacatgagcaagtgtcaggtcgagccaatattcttgcatataagttctcaaaggggagaatcagcaatgcctttttgttgtccaccaagtctactggaatgagcttgagtctcacaatttccacacacaactcaaagcaaagcagcataattttacagctgggcttgctcaaatttaaataatcagagccatggcatctttctatctcttattctagtgaacaaataatggtaatcataacaaaaaaatagtaagacaaagtcattattggaagtcctttggcagatagaatcctacataaacatttttaaataatctgtggtcaggttgagcctacttcccagaacttgggatgattaatagtattggcagtttaaaaaggactaaaaaattttggcaagtcaaatgaaatggttctaactaaacatactgctcattttgctcaatcaaaattactcagtgagtataaattcagtggttttaacagaggaaaaattttgtaaattttaaaaataggctacctctttagtgtaagcactatactaatgtagacataaaaatatatagtatgttttgattcatagatttataatattaataattacaactagataaaacaatgtgtttatgcagttaaaagtcatgcattaaaattttttcttatgtgggtcaatgatgaaaaatttttgttggttggaattagctgttcattataacatgtctgtgttgcatcgtgtgtgtgtgtgtgtgcgcgcgtgcgcacacgtgagtgtgtgtttacttatctatggctaatagttttctctgaaaaactaaaatgaagaatattagacacaataaatgtgcagaaactatatttacataattgtcagggtctcgagaaacatcaggtaagtgtgaccatttatttccatcttcacaattgcttctctgtaattaagctgtgcttcttggtgaagccttcttgaaatgccaagtatttacacctgttttggatggttgtcatcggtggtattttagatttcccagtttgtttgttaggagaagcactagtgatgtaagacaccagaactgtccaatttgtaaaaataagcagggataattcagatggcagagacttgatcctgggtttgggtgagtcctttgtttacccagtgcccatcagtcacagctatgctaccaagcagcatgtttaaactttcattaatatgtctatgaccttcatgcttaatgagccttcaggggtctcagcaggcaacattttgaaataaacttcataaggaataaacaaggacattggaaacaggcagaggaactagcaagagcatttggtggtgtaaaccaaagtctaaactatcagtagaagccaaagtgattcaaagtatctcatgtattttacaaaacaaatgctcttcgttttaaggagagaaatgaaaaatctcaaaacacagtccaggaaaaatgaaacctgaattctaactcagtaaaatattattcttgactttataaaagatttttctctacatactggactctttaataacagaacttattataccatttaactgctacagaaagatggaagttatttaaaatatagtatacctattatatgttgaaattaggagacttttagggcattaaaatatcccaggaaaggagagggtccaaattgctagactagtttcatggcttcactgagccctgacagatcaatttaatatttgaacatcattaatttgaacatttctcatgtaatttaaggctcacactgcataatacagggatgcattcaggatctggacttggagaggtcgttttaaaaagccattaaggtttagaaatagaagaaattacagtagttagtaaaatactatggaatattctgcaacatgcctcagttgtaaggctaccagatcctaaagatggagtgaaaattgacaccaactagtcagagaggtttctatacatgtttcagagcacacatttgtatattttattgaatgtgtatatgaaagctagagacatgggtcattacttttcccaatcgcctttctcccaactctttttcttggaagagtcaaggttgttacaggcacacagaaatacactggaggaactcagaactgaccctacctactagacacttagtcttacagtgatcttccccttttctctcttttccttttcatttataatagaaacaaaagttatagatatttaaaacacgtatgctttccccaaaacattaaggcacaaaaggcattcattttatgcaaattgatcataatcatagccatgaagcaaacatatctcatgatggttttgatctctaatgttttctcttgcaaataataggtctcttaatcacgttaaagacctttggtcctatagcacatgtcattttaaaaaaatgcatccacaagagatttgacacaaggcactcttgattgtatctgtttttttataagaaacaaaaataacaaggtctaaattgcaaatatacttgatttcatcttactggtacctttaagaagaatcagagttgtgtttagaaaaggtgttgaggtgtgaaagctgtagataattggactctcaaaatatgaaataaacgataaagtgtggataagttaaatttggaaaagtgatttttgttggacttcattttgtctagactttctcatttcccgttacgtaatttgtgatgtgacactaaacattcttgcacacataagaaactggccatcagagaaatgcaaatcaaaaccacaatgagataccatctcacaccagttagaatggcaatcattacaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccatcactgggtatatacccaaaggattataaatcatgctgctataaagacacatgcacacgtaggtttattgtggcactattcacaatagcaaagagttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacgaaaaaccaaacactgcatgttctcactcattggtgcgaattgaacaatgagaacacatggacacaggaaggggaacatcacactccggggactgttgtggggtggggggaggggggaggggggagggatagcattaggagatatatctaatgctaaatgacgagttaatgggtgcagcacaccaacatggcacatgtatacatatgtaactaacctgcacattgtgcacatgtaccctaaaacttaaagtataataataataaaattaaaaaaaaaagaatttaagatccctcttacacaataatattattctgtatttaaagaccgctatttaaagaacattttcattgtgaggctatttttagtccttcacacttaatagtggagataatgataatatttttttttggaatgatgaggcgaatgatgagatatttttaccccctgatgcatcatttacctagctcaacaaatgtgtggagttattggattttgttatttatatgggtgtgtagaagggaaatcttgctttctgccagtcttaggggagcattttaatctgataatgtctctgtgaagagccaaatagttatttatcagttctatctcatacttaagtcacttgacctcctagtcaatattatgagagttgtgtatgaacttcgttctccaaaaacttcagaagtcaatggaatttgatgaaaaataagggaatgaatgaggaggaaactacttcaagaacaagaatcaacaggattttttagggggcctgttcacctttataacaccccacatttccaaatgacagcactttctctagtgattaattaggattccagcagagttttcataaatttggaatctagttaaaagggaactcattaaattgttaaattcaaactagttttcctaggttatgttcctttgaaagtgctcagtgaatgaagcaatgctctatacacacagtagaactacggatatatatgtatctatggctatatagatatataagattctcatagatgacatcattgtcatatatattacatatacctacatatgcatatgtgggtggagagatagatcttgaaattgaattcaactactctaataattcagttttattgtcttttatttcttatttttcttgttttctcttgtcttctttaatctctttttaatgctagcaattaaagatttgagaggctcaaagtcctaaaatgacataatatttaaatgtaagcatattttggaaattctaagatagctgtagaacttattttttacataatcctgagaaacaactatggattttttttatcacaacagttgaattacaccaagtcattgtttcattgggaatggaaataatactgacagattcacttcactctttggccttataaataacaatctgagcttctcacctcaggttctacctggtttcataagtataaatgtagactgtaacgtaaacttatccctctattcttcagtcaaaactcgggagcatgaaaagctcacaagacatctttcttaaattcatatagccatatgtattcatagttgatatatatatatatatatcccctagatagagtgttattgattttttaacatattctgttcatctttaggtatggaggaaagttttcagtccacagcagctttgcatttgacagattttcaagtaaccattatcttagcgaaatgcatccaattcaattcagcctttttttgttgattttagaaaccaagggttttctttattttccatatttatgaggagggaaaggggtatgagaaagctactgaaattctgtctaaatgggaagggctaaagatatgctcaaggtttgctttgtttggctttgtttctttgaaatgtacacagggcaagttgagccatgaagtaaaaacttctgaaacctgaggttgataagcattcccaaattacttccctttgtgagatgctaagatgaaaggtgtttcaatgaatcacctgcttgtttaggtgtgacatagggccacatcacaggggcatcattttttgtttgtttatttgtttgagacaggttcccactgtgttgcccaggctggagtgcagtggcgccatcatagctcacagcaaccttgaactcctgggctcaagccatcctcccaaggatggcagcctaggactgagcagttgtgtttattgcttaaatcgtggagcaagacccttagaagacattgtattgtgaaaatgcatgaagatgctcagagtacatccatgaaatggtcttgtttgttttacatgtgattattagcattccaaactctgtatttgaggacaaagtattcttataaagcagcgtcgtttattaaaacatttaaaagacaggcaaacgatgggaaaatcctctaagtcatatatactatacttagcccctaggtgctgtgatggaagacatataggtactggttcaatgtttatattaagagctttataatataatgtgaaaaaatgagtgtagtcaaataaagaagataactgtgcattcaagaaatttgtatcatccttttttctatgttttcttcccccaggtattaataaaagcttaggtgaatttttagaatatagattttttcccattgttactgtcatctttatttagcagtgatatttcaaactattttaagatctttagtatacatatgggagatacgaaggaacaaataacaatggtattttgtctgtgtcttctctgagaaattcaacaggttgctagtgaaagggctgtttagttgcaataacattttactatggaacgttatcagtttataccatgtgaggtgttcatttctgtcacagtgagagaacatgcatccttgctgtgttctcaatttaacttaaatctcatgatttcctgttttgaacaaacatctacttaattcctggctcctactccccacccactggcagccgctgtgcagctgccgtgattactaatccacctggcgatggtcaggggaaggtattaagtgaaattttgacttatgaagggctaaactacttacagtgcaatagcatttccccataatgcataaaacacgtagagaaataaataaataaataaataaataataaataaataaataaataaagtcagagaacaagatcactctttatccaaataacacaggttggttttattgctttaaagcataggcacaaaaatcagcctttgggggaagacgtggatttcaactcactattgccaaacacgttgatataagagatcgtgtggtatgcagctatgtatagatgtgtgcctgagatgtgtaggaatctcgagaactttttggatgtttcttcctgtgatgttggaaagacttggtagaattacataacaattcagtatgagtccttagcacgatccttttgtcttttttcctttttttttttaatacatgaccaaactgatggaaacaaaggtagcaggctgatgctgtaaggacacggtgtaggaatgtcttatgctagttagtccatcacatgctagttctatttatttatttttcctgagatggagtctcactctgttacccaggctggagtgcagtggtgcaatctccgcacactgcagcctccacctcctaggttcaagtgattatcctgcctcagcctcctgagtagctggagctacaggcacccgtcaccatgcctggttaatttttgtatttttttaaagtagagatggagtttcaccatgtttgccagactggtcttgaactcctgacctcaagtgatctgcctgccttggcctcccaaggtgctgagattacaggtgtgagccaccacacatgctggttcttaagaacaagtgagaagattctgtattgtgaagtcagcctattgcattaaacttattgtttatatttgattcaaaatctgcttatgacaaattcgatgtcatttttgtgttgcaatctggtgtctgtaggcctttgccttgcagtttcatgtgaaataacatttttaaaaatggtttgtacctatgtagagcttattctaaactcagagtgtggattggtgtcttggatgggagctgctgtgtgttttccttcctgtgccacccttcctcctccagacacttccatgtggctggctgcggctaacatcagccatcacttatacatagggtgagaagactcgggatttggtatctttaccacttgatctcacttgctcccctttcttcttggtgcatggaatttacttcctctgtaggcaagtcaagcctcctccttttcagtcttcaggcagtctgagacctttcttgccttgcaatctcagaattgcagcattttattatctcagaattcctctgaaagtgctgctgaacttgaaaagcagtatctagaactttgtattttcaagacttcgtttgactgtttgcctagaattgagtccacctactaatgtttgctcaggtaactaagtcatccacacatcctgtgcttatctttaagctgacaatcctaaaatgagagccacatcctcactgtaatgcacgagatgagagccaagggtacatacagagcctgagaattcaaagtttaaaaggcttacttagggtgtctcagtaaaggacacctacttattcctgcacaaacaatcgtgggtaaagaaagagatggaacaccttttgaaatgcatatgggtagcaaaccatttttttattaaaaaaagttattttaagctaaatgtgaccctaacacacagtgccccccaaacacacacacacacacacacacacacacacactttattatgtgacataaaaagtgcattattaaattaagcaataattaagtaattatttgacaattataaacaacgaataacctctaaaatgtttgctaaagttgcaatgtttaaaatgtatgccaataactagcttttacatagttaacattagaaaagcttatgctgaaggaattgttctttctgaagtaatttgattaataaagattgctgctctcttgcacaagattcttgcacaagttgggagaaaattctgctgagaagggagaagtcacatggtggtctggtggggagggcaggactaacagcccagaagttccagagcttgtgcaaggctccagggccagtaaatgtgactgacaagatgaaggttgagctgtcttgtttccgtgcctgaacgctttcccctgaatttcccagtctcaagaggctatgattctgcttttggtcctgtgtgtaaatcactccagttctccacccatgtctgttcgagggtacggacatccctcttagcatggaaatgtgattgaagcccaattacagccatgaatcattcccaaatctgcaggacatctcagtttagctggggctttttagaaaaattgcaattccaaagctccacccttagggtaatgcagacctgtcactgagcagaatcacaaatcagaatgggaacagggaccagtgtctgtgtttggaagccaactgtggtttaactcatcctacttctcagtgacctcttccattcacataggttgctatctcttatctgatcaccctccataatcaatacattggctgaaatgatgggaaaaatattccagctctgcagtcattttgtttattagaatgttgtgcttgggcagcaattccatcccctgggaaagactgaggaaggtccccagtagcaggaggtagcatgatatgatacaagaccctgggctttgggttcagaggcaagttccatcctgactgtgtgttcctctgcaaggcaattaacttcctacatttaaaaaattctacaaactcatacaaatacacttacctagtgcattgctatgaagacaaaatattatttacagtacctgctcaataaatataagggtcttaggaaactccttcagagggggagaaggcagaggaaaccctctactcttgaactactcctctttttcttgagacaggatctcactatatttcccaggccagagtgcagtggtgccatcgtggctcactgcagcctcgacctcctgggctcaagcaatcttcccacctcagcctccctagcagctggaactaggagtgtgtgctgctatgccaggctattttttttgttttgtttttggttttggttttttttgtacagacaggatctcactatgttgcacaggccggtcttgacctcctggccttaagtaatcctcccacctcagcctcccgaagtgctgggattacaggtgtgagccactgtgcccagccttgaactactcttatgttcatgtcaaaaaccttacctgacctttacatccacaaatctgtcctgcaagatgtatgtgtatatgcacacacacacatcaagagttgaggatcatttatatattcacatatttttttactcatatagaactatggataaagagtttgaaccaacataaaaagctcttttattttaaaaatgagattaatgaaacatcctgataattattgttttctagtcttttgatggtagctcatataattttgaatgacaaatatgctctctctttatttgttttatatgtatacatggtttctgtgccttagtaaaaatgccaaccaagtttatttttttccttctttgaagaatttttgcagagctatgaaggaaatatagaaaataaaagataagctactacatggaataaaattcataaaaagcccttccctagtatttctccaagtagcatcagctgcatatttctgcagagtgctaagttgatatttttgataattcaaggattcgagccaccatccagtttcattctgcagatgtaggatagtttaactgctcaagtaggtcataaaatacaccatttataaagcacttaggtacactgtaccatgcaaaggataacatgctaaaacaaaagccttttttaaggagtttgatattaaaagcatcacaatgcaattattcatcctcaaaggtctgtgttgcagaattcatggcttagattagagaatatcaaggggcagcactccgaagtgtggcaaattgggggaacttctcctagcatattgcacctcatgataactgaaaccaagtgcagggctggctatttgctattctatgtagcagttagacaaagctaattagcaatattgtgcttagtaaatatgtttcaacatacattaaccgattatccatcggtgaaatattgcacaattaattttataatataactgtcaactgcagagatgatgggcatgattcggagcaagagcctaccagaggctgtttctcagccttggtactgttgacatttggggccagatgatgctccgtggggctgtcctatgcattgcaggctgttttgcaacgtccctagcctctatattctgaatgccagtaactcccccactctctgtcccacccacgttgcaacaactcagaatgtctccagacattgccacacgtccactgcggaacaaaattgccctggttagagttactgtaattctcaaattgccgatttttacgttagtattttaaagcaccccaggtcattggaatttgcagcctagcttgacaatcagtgggctattcttttgcaacttaaagtcagacctaccaacccggaacatcagcaccatctgagagcttgtcagaaatgcagattcccagacctacagacccagagtctgcattttaccaagacccccaggggatttctctgcacatggacttttagaagccattctctggcttgtacagcctcctcttctcagagaagtctccataattcccaggtcccgttgagcagacagtccaagcaagcagatacaatggttgcacctcgtcaccctcacaacctcacagcagactggattggggaagatgcctgacacggtggatgcagtgggtggatgcagcatctatcagttaccaggtaaagaactaattaaattctctctagagagtttttgttactgacaagggctctagagactgtgttggtttttgttgggagacaacgagattgtgttggttcttgctggaacacaacaagaagtaaatacttggggcaaagctgaatgacctgaatggcagatattgacggaggaacctctcctgctcaggtcttggctatctctgctctcatcttttttcctttggttgtttcctctccctggttcagagattttcctttgcctccaggttgcccttggtgcccagctgtgggcgtgcagtgcatcagctattcttgggttggcccaacccttgggttgggttggcatcagctattcttgagttggccttttcctggcaagaaattatacctgtgacaaaaatgaaaatgtgttttactttaataaagttggaggatggggatgtaaaataatggtaccatactgtatcattaagtttataatgcagattctataattgcacattgtctagtggttgaactcttatgaagagccatttgatgtttaaagaggcataaaaataaatacctactttgctgtctaatattgttgtaaaagatacatattgggaaataatccaaaataaagaaaaggagaattaaaaacaacttgagtgttagtaagtaaatgagtaaaaaacttatattttgtcaactgatagaaatatcatacagccattaaaatgataatccctaaatttgtataacaacattgaaactgtttgtgtcaattcagcgacaaaggcaaaaacaaaattttatccatggcaggcaagattggagctgtaaaacgtgtggatgcataaggagaagattggaatgaaacacaaagagtaaaatgtgttgatttaacatgagatggtgcacatttttagatttttgctttcataaagttagatgattggtaaagatgtgcatgtgtttctgtcacctctatcatgtctatcacctcttgtcatgtctcttgaagtgtagtgcttcttaaactttccctctatgtaggttgaaaaatccaggagaccatagatacactttaatgttaaatgagcacgagatggcacgatttttagttgctatcttcttagctagttatttttcattccactgtaacagaggtgttttcaggtatacctaagtgcaagaatgataactactttgtctataaaatttgaagtgtacttgtctataaaattttaagctttattttaattaagaaaagagcagctatgaggagcttggctggggctgcattcagaaccttgctgcagttattgtgaactgttgtggacgcttacatgaactctgtaagtcttgctttgttgtccataaaatggggatggccacagtagaactggcgccaaggtatttgttaaaattaaaggggccatttaaataaaaagcacagtgtaatgcctggcaaattattactatggaaagcatattaattgtctttgttgtttctatcttatgtcaaacagtagatctgtgtaaggcagataattatatggtcaatgacttacattttactatattttcaatcttaatattttattatgatctataatcattcctatttgactatcacttatttttattaagcatcaatgcattcctaataaacttcaatattatcaagatgatttaatggaaatcatggaagactgttcgtttatacttaaattagtgtctacaaggcacgcagacaaaactattagttaagaaggcctgattgaaaagtacaacccattttttattacttttgactataatacttttttcttaatttttctattatgacatttatatgacctaacctattgaaattacttcctgacaccagcaattcacatctttcataacttttggatgctattgtttctccccctgaagtgtgctactgtcaagatgaagccactacagtagtattcagtatgatggcacattcttatctctggtcaaatagaattttacaatctgtactctggcagtaactgcaccatctcaatctaaatctatttgggttattcttaatatattctcagtaaagagaataagatagttatgtattttccttcaaataattaactttaagcaaagctttcaccaaagaggatttcattagataacagtgttaactctgcttactattagaacgcatccctgagcttataattgaagtcatcaaggaaacaatgttcagctaactgaaattttatgtagtaacacccagtggaagtgccatcacattcattaatgaaaacatcttgtgctacttcttgggcaacagctcccattgagtctgtcttgcttcactgtgtcttgactgtgtcttgaagggaagtgttatctactgtttgcttcagaccatcttttcaaggatgtttgtgtagcaaacagttttggaaagataggctatactatcttcttccagagcaaagggccagaatgtccaccactgcattagtctgttcttgcactgctataaagaaatacctgagactgggtaatttataaagaaaagaggtttaattggctcacagttcttcaggctgtacaagaagcatggtgttgaccacctgctctgcttctggagaggcgtcaagaagcttacgatcatggcagaaggcagagggcattcaggcatgtcttacatggccagagcaggaggaagagagaggggggaagtgctacacacatttaaacgaccagatctcgtaagaactgtatcacaggaacagcactatagggatggtgctaaagcattagaaattgcccctgtgatccaatcactccctcgaggctcctcctctaacactggggattacatttcaacatgagatttgggcagggacacagatccaaaccctatccactaggatccttaagcatgggatgcctcttctgtaacatatccactgtatttgtaggagtccatttcagcctatctgcttcagactggtgggacctcgatgcaaacagagctaatgaaaatgtgatgcttctgcttctttttgtgccatgaataataatctgttctttatctctgacccaggagtctcatgtctttggctaacccctgtaaccttgtggcaggctaactagtaagcttgcatgtagagtaaaatctcaggcccttcacagttcttgatgtgtgtaggtgtgagcatccttaggcataagttgctaggatggctcttgtgaggaaaaaaaatccatagaatttaaatttagaatggtttcttgtcagaatagtgtttgtgctctttttgcaaagattttcaaatccactcaatccatgtagttttacactagctggaattttagttctaaccattgagaattattttttgggttctgtcttagtccgttttgtgttgctataactaagtactgagaatgggtaattaataaagagcagaaatgtattttctcacagttctggaagctgggaagtcccaggtcaaggcaccagcaggttcagttgtctggtgagggctgcatcttccagaagggaggatcactgtgttttcacatggcaaaaggcagaagggcaattgagctgaatgctacctgcagcttcttatatgagggccttaatcgcattcatgagggaggatccctcaaggcacagccaccttttaaaagccctactatctacattggtagtgtcgcattggttacacctgaattttggaggaaacacattccaaccatagcaaattccctgcaaaaagttacgtgtgtatgtgtgtgtaggggtgtgtgtgtatatgtgtatatgcatacatttgtgtatatatatatacacactcatatatataatttttatattttatatcttataaaatataaggatccattttattttcttctggatgctaacagaaacattcttaatcctggctgcacattagcctgggagaggaggacttctgaacaatcccgtggcaccaggcgtggtgactcatgcctgtaatcccagcactttgggaggccgaggcaggcagatcacaaggtcaagagatagagaccatcctgggcaacacggtgaaaccccgtctctactaaaaatagaaaaattagctgggcgtggtcacgtgtgcctgtagtcccagctgctcaggaggctgaggcaggaggatcacttgaacccgggagacggagattgcagtgagctgtgattgcaccactgcactccagcctgggcgacaagagcaaaactccatctcagaaaaaaaatcggtagaccaacccaccaaaatctcttattaaatcccataagaccattttaaatatgttgccaaatttaagaaccattggcagaaattcacaaaatgtgacagttttccttcttgtcatgtctcttgaagtgtagtgcttcttaaacttttcgatgtggccaaatcacttggggatcttgtaaaagttcaggttctcatctggtgggtctgcaatgggtacccaataatctgcatttgtaacaagctctcaggtgaggccacggcttctgattcaaggtctgaattttgaatagcaatgtcgtagttgttattttcataaagcaaaagcaaaacaatacagaacaaaagaaaatgtaacccaagcgtcaagtgtttcagctgttgagatgcagtacatgctctttgctttttcctttttttttttttttttttttttttttgtgacagagccttgttctgttgcccaggctggagtgcagaggtgcattcattgctcactgcagcctcgacctcatggactcaggagatcctcccacctcagcttcctgagtagctgggactatagggcacaccaccatgcctggctagtatttttggtatttgctgtagagatgcacaggttgatctcaaattcctagactcaagtgaccctcccaccttggtctctgaaaatgctgggattacaagtgtgagccactgcaccctgccatggtacatgctgttaaaacaatcatttttttgataatactagtgatctgaaaactaaggtatggaaaaataaagaaatactgctgtcaggaaatcagcaaactgtctctttataaaatacactgatttttgccactgaaatcagcatttgctacagaatgaagcccatacaattagaattttttaagcatctgaagcccccctgcctggccttggcatttatgtagctgaaagggagcattactctaaaaaatgctttctttctgtagcacatttttcattaagaccacgttgtcacttaactcatattgcttaagaataccatcctggagacaaaaacatttcaaaggaattgtaccatgacattcctaccatgtgggtcattacaaattgccttgctgtggtttaaaagcagaataatttaaacagaagcacaagtacaagctctagaactatcttcccagtagggttttaccctgcagggtacaagcaataaaaacattgagcacagagatggaaataggctgtggctcaaatcacacacacacacacacacacacacacacacacacacacacacacccctcacattcacacctgtttccctttcttgctggaggtgaaaattggaatgctattataagcttgtgcagatgactataactgagaaatcaggcacatcacagggaaatcattgcacctacagcctcattctttttttgaaagctggcagggcacatgcaatataaaatgaagggtgagacagcatgtctccagcaggacagaaaaggttatggggcactgaggaagtatgggaaatgctcagttgctctcagaaacaaacaatgaaataaataaaaatactggaaagagagacagaagcatagttgtagccttaggtatgggtatgccaaaacacagggagtaaataataaaataaacatgtgaacataaaggcatctatgtgtccccatgtgtgaggtgtgactcaagattggactatagcaatggcagaggatgttttgttcaaaagctagatagatatgctgtcagatggtagtgtcagactatacactcggccagcataaaaattgcataaatctatgaacctgtaatggaaaccacaacacaatcgatcagcattgaaatactttgagaggaggacagtttggcataataggaacctacactgcaggtcaacatccagggaggatatttggaaagtgttttccaaacaggtaattacaagacatcttcaccacaatcatgagcaatagaaagctatttcttgtgactaatgtagcataagacaaattctattttgatgaaaatttgacaaaagacaatgaaatgaagtaatattacctgagcatatacgtatatgtaccaggggtatttaaatgtgctgcttcctaatttttacaaagccttatggaaagtcttcattttatagttcgagcaacggagactctgagagcttaaataatttataaggtgcgtccagatggacaaagctgggaaacaacctcaaggttgattttttttttcttctttgaagtatcaagtgaatttacccgtacacacccactgcttgactagactaagatgttcaaaggagaactatcattggaaaaaggaaagaaaaagaatagcaaatgaaagttttatagcaaatgaaagcagccatcctcactgagaatctacctcttttccggagctatgttttatgatgagaatttgtcactaatcctccagaccatggtgagatttaggaatcactgttctgagtttgcacatgaggaaactgaggataggagtggaccaggtgccctggtcacacagctagaaaatggccaagccccctcctctgctgccacctagagaggttgtccactgccttccttctcactctactgtttgagctccatgaaaccatctctttcctcttcaccttgacccttttcctccagagaacacacctcactctaagtagtcaagcatccataggccatgcctctgtgttacttcatcatccatccccatcacccctcaccagctctgcagaggaattcaaatgtgtgtgtttcgccatgagcagctactgcttttcttttctctttaggtgccctctctcattttgcaagaaacaaaacaatttaacaaagcaattgttaattactttgggaccctgcactcatccatcctctggtcctctggcagatttggagactcagttgtaataagagtgagatggccaggctctgcttcttcttttttttttttttgtccaacatcatggtgccgctcacaggtgttatcaacaagaaggtagatgtgatgcctgtggcagattggagtctttaaatcctttagatgtcatcaagtggactgctcatctggctaggagtcacagaattcaatgcaccatcctctgcttgatggactcatagagggtccctgcctttctatcaggcagctttctgcttcatttttctttttatcacactgtaatatcgggctgactctgaaagtggtctataattctgttagcgatccttctgtgtttctatacaaaacattcatgtccagaagcccctgaattgagatattgtggctgatcagaatagaagaagccctagggccctgaacatggagcaaataatctgctcccaagcttggtcctgaatcaaatcctttgacttgaactaacctgcgatgcaagcttatttgactgttgtcatcagaagggtttcttcggcaggtgtgaggaacagcatggaatatcattctaccctaccaattggagcaaattgttatcacatgactcagttattaaatataaaagaaagaggggagagaagataaaattggttacaaggttgagagttgttatttcatgcagtgactctctttggactcttgctaagtaaaatatgagtaacaagtacaatatttttgttttcaataacctccagttctctgaaggctgagctggctttctggtgccatcttgaaggaggatggaatgtagctgaaatctatgccagagagtaaatgaagtggaaaacctgtgccttcagtcctggtgcaccttgaaacaaaaatggagagagagtgtggtgatcacagagcaggatcctcatttcccccacttattttgggatggagctacataaacattggaatggcataaagatgctgtggaaaattagcacctgtgtctctcatctctgctggggagatgatgaggctctcagagaaagccaagtcttgcaaaggctcatgatctctcatggtttgagaggagtggggagatgttatctgagggcttgatggtctgggggttgggaattgtagctcacctgagccattctgtgacatgtagtggattgggaactttatgtatatgtgaatgtggagacacaggagtgatgactaggaggtcaatacgggagggaaagttgctatatgcaaacttggaaactagtgaaacatgactggggctgtgagcttcagggtaggatgctggcacattcccccagcaggatagattggaaagatctaacccagtccaggaaccaaactctacaggttcctctatggcacagaagagtgaggattcatggcacccacaaggttttaagactcccttcttcccagcaccctaaggtcatggtagattgcctatatacatagatagtatcatggggagaagtatagggcaataacaaaattagcaactgggtattgacccaggagtcaagtcattcaagagactaaacagaagaaattgtcacactctgaattggtgggttgaaagtttgtgattatcccacactctcattgaggtgagaaagattagccaggtgtggtggctactcaggaggctgaggcaggagaatcacttgagcccaggaggtcaaggcttcagcgagccatgatcatgccactgcactccagcctgggcaagagagcaagaccccagcactaaaaaaaaaaaaaaaaaaaagattagatctacttttaaacgcataaaaagcacatgttttctttgtgcatctgagtgtagaatgagagcattttcaactgaagactactaaaacagaaggcaggaaggcaggttcctcatctcactttctgacattttatgcaaaatataaacccactaattgttttttcaataaagctttcaaaataacattgacatttggatcattttcagtgagaggttgaagagaatttaagttttattcatacactgcagtcccaggggaagaagggtgaccctcaagataaccacaggaatcatttttttctaggctgagaagagagtggtgaggcttcctgagctatttgtactagtttacccttaggtctttcagctagctctggacaatgaggttcccgcacggtctgatagaaacaccaccatgctaagtatcagagaacaaacttaagagttgcattattaaaaacatattttttctggagagttttaccaaaatgaaatgtcttgcttctattggtcttaggagagatctgactcatgtaaaaacatagggttacagaactttggaaatacagccatttatctatgcatatcatgcttgcacacagatttctttcctaggatgccattttaaaaatgcacattttgggtaaaaaaataagctgtcacatatatagacttctcctagtattcggcttaaacatgtgatgatttgggagggtcgttcatgtccctagtggtttaattgctaagagaatctttcccgtcctccacattaacagttagaaacaaaagccctttgtttcaccagatatgtgcttgggaaatggtccattttaaccacatcccatctgtagggccatgtgcaattttaagctttaataattttagatgaacacaggactgatgcaaatgccttattaatgttcactcatcagaactcaattctttgaaggaactcagggtcgagtttggaaactcaatttactaaattgcttagcaacacccagaaggcattttcaccaagttagaaacttataaacctgaaacttggaaatttcagaagaatgagtaaggcattcactcttaatagaacttgcttccacgggtcacccatctaccaaataaataccacagacaaaacaatctacctatataatatttggggagttttttgacatattgtgtccaaaaggcatgtgacaggtatttttgattgcaggagaataaagagaggctcactcacataaagttttgagtatcaaagttatatgttgtcagtccatagtgataaaaataaataattgaataaatagacaaatggagggagagagaagggcaaatcttctttgcagaagaattccaataattgatatagatactccatcctcagaaaggtgcaacatcattttccacaccttaagcgtgggctgtgcttagtaacttccagtgagtaaagtaggggaaggtgggaaaagtaacttcagagtggagaaacctgacaaacactacccgaggttgattaaggtcaacctccagagtgataagtcatgttgacagcatgtacctttaatgagatatgatgaaaatggcattttacttctatggtcttcatgcccaaaacctatagcctttgttgaatcataattaaaacatcagacaaactcaaattaacagacgttctacaaaatactcacccagtacttcttaaaactgtcaagatctgaaaaataaagagagggagaaaccgtcacagccaaggagacataaaaactaaatctaatatgaaattctgaatgtggcattagataaaaataaggaaatctggataaactatggacttttgttaataataatgtatctaccttggtttactaattttaacaaatgtgctacactaatataagatgttaataatagggggaattgaatgtgggaaacatggaaactctctgtactatttttgtaatttttttgtaaatctaaagctattggaaaattattttaaaatgtattaaaactatttggaaatttataaaaaagatttaagaagttgtatgctgtctaatatggtttggctgtgtccccacccaaatctgatcttgaattgtagctcccataattcccatgtgttgtaggggggacccggtgggagatacttgaatcatgggggcagtttcccccatacagttcttgtggtagtgaatacgtctcatgatatctgatggttttataaggggtttctccttttgcttgactctcattttctctcttgcctgcccacatgtaagacatgactttcaccttctgccatgattgtgaggcctccccagccatgtggaactgtgagtctctttttctttataaattaccctgtctcaggtatgtcttaattagcagcatgaaaatggactaatacactgccaatgtgatttttaaaataataagtgttttctgcaaacagcagctcccatctgatgtccttcatctcagaatgtcctcttgttccagagtggatctcatacatcccgcaccatctcttgtaggattgccaagagcttttgcttatttaactgtcgtattgttcactgggttggcacgcgtaattcctgtgtttgctactatatgggatactacgctagtacatctcgtataaacactacttcttcacttgacttttgttggcacttctgttttggtactctatgccttctgccttaaatgaccccttcttatgtacataaatctctctcccacctgttttataacgtccaagagagatatattaatagttacccatccttcctccttccatggtgtctagtgcaattcataactagcagcacagtgggcatggcacgtacttcaaaaatacttatgagtctgcacaattaatttgaggatcttaaaacatttccagaaaggaatggcagttctgaatccttggagatttcctatttcactttcattattccagctttttacttttagaactctttcagggagatagaaaattgtcagcttattcttaaagatattcagagaaggcagttctaccagcttcagcaggagtctgtttcagaatattaaaactaactgtatcaaaagaaacttttcttcctctttcacctagttggtgtcttaggccacttcccttccctcagcccacgcacattgttttcagctgagataaaaatatagctgagcacagtcctatgtggatttgaagatcattaagtttcttcacagctttctttttgccagaacatgatcatcttaatccattttctatgcaggtggggttttttggtgataatttgtttttggtgattaagaagttgtatgctgtttggtatggcctttttttggtcattaattttttgaattttaaaaatttatcaacatctccattgtctttgatgtctaaggtaaaaatctgagaatactactacttgattaaaaaaattaaaataatattaggaagaagaaggaggaggaggaagataaggggatggagaacgacaagaaggaggacaaggagaaagaagggaaggagaaggaggaggaggaggagagagaagagaggaagggagatggggaggagaatgaactactaaagctatgtggtaaaaaagacattacttacattaaacatttattatttgtaactgaaaatttactaagttacttaaaaaaattatgatctgcagtgatcttcttgatcttagccatgccacctaatcttccaaagccttgtttcactcatcactcaagtgaccttgcaccactcaagtgaccttgcgccaatatttgtcgagtttgaatgacaccactaaaggtctcggccctccaggagaaaggtattgtgggcaaggatggaatgctgcatgtggctttgagtatatttcttcatacaggggagtcagtcttaatatttcatggaagcgttgagtaagtagagaatagggatgaagctgtatgtcctctgagctatgccagctctaggagagatagcagcacatcaaggggtggaagtgagaaaaatacttacagattttcatcgtcagctttcaggcaacactagcggcaaaggtaaccaacaactctgcccaaagtcagttctcctaaaaccagattttctaaaatttaatccatttttaaaaagttaacctaaaatccaactcccttatgagttttttttgtctctgaagcaaggtggtcattataaaattgaacttcaatgtattttgatcttctggtgaggaagacattgggcttaacactgcccaacctacacttggttgatattttaggcagagcgtttcaaaagctttatggtccagatattgagaaatggctatcaagagagagaatgttgcaattggcttttgagcatgaccacatatttttacaaagatgtagagctaccctgaaggcaatagatatatccactctcaatcattctgagaagagattcctcctgaaccatgaattaagactcagggtaggccaggtgcaatggctcatgcctgtaatccaagcactctgggaggccgaggcaggtggatcactcgaggtcaggagttcgagacctgcctggccaaaatggtgatttcccatctctactaaaaatacaaaaattacccaggtgtggtggcacatgcctgtaatcccagctactcaggaggctgtggcaggagaattgcttgaccttgggcagtgaaaattgaagtgagctgagattgtgccactgcactccagcctgggcaacagagtgagactctgccaaaaacaaacaaacaaaaaaagactcaaggaaacggtctgagatgaggcaaaggaaaacatttttcttcgggacaagagttcagtctgactcagactctgagaaatgcacaatgcataaaatattttcagttgttggaagatgaggaacatcttgctactggggtgcaggcaaggttattggcagggcgttgagccagcaaggggcctttggctttggataggcgaggttaacacagtcagtagttataagatgttttctattatgtaaattccttccattatttctgaaaacttcattcacttcctgctaatgatttcagcctgatctcagtggctccgtgttgaacttagaaagggtccatcccctgccagagtgacacacaagacaatctttccccctacctgggacaaggtgacaggagcaggagggtataaggaacaaaccatattttagttagcaataccctattgtttcaaatattttattatccataatattgcaaaaaacatccttacaatcaagtctttcttcacgtcattgactatctcctgaagatgcacatgacttttcatgtcaaagggtatacacagttttgaggcttttggttcttgtcccgatagaggcagcagaaacaaaatggtaaataagaaaccaattgatctgttcttgagcacacctgagccagcacctgggcgcctcttagaaatagctgtgggacaccttgagagaggttaatcttgagtaactggactgatggaaaataatctatcacaatgatatcatgaaatagaattagctttgttgttgtagtctgtagcacttttattaagatgtagtcttagtcatgccatctttttagcatttcaataatatttgtttattttgtataatattcaatgtgtgtatatatttgtgtgggtgtatgtgtgtgtgtggttgaaacacaataataaaatgaatgtgtgtgaacctactactcagttcatcaatgaggacattaccacaactaagcaatctattgagtattttgctcttgagttttatgaaaatatcatataacatgtactcttctttaattttctttttgcatttggcagtcttaagatagtctgttttgttaatgtaaggatagttcacttattttcattgctgtaaaatattccaccccacgcatatatgttttatttatcttattcctgttgataaccatttggatttttccaaattttatctactataagcaatgctgatttgacattctttttcatatcccccactgcacctgtgcaagcattaacgtgaggtatattcctcttaggagtgaaatcgtggagtcatttgtttgtgactattcaactttacaagttagagacacattgttgttcaaatagctgtgtcagtatacaccctgattgccccaatggtatgtaagagttccagtggaaacacatcttccctactattcagcattttcagtcttaagttttacccatccagtgggcatgcatgagatctttttaaaaattaccctgaacgccttttcacatattaatgagcattttatttcctgatctgtgaaaagtctgttatgtgtttgtccatttttattctaaattgcttgtctttttatttttgatttaaaggaactctttatatgtctcggacacttacctattataaattattagatttgcaaatatctgtccttcctcctccccacacacactttatgatatctctgatgaagaggagttcttaagatcaatgtggttatatttatgaatcctcttattcatggtctgtgcttattgtgtctttaaaaagtattttccctacccagggaaagatcatagtatgttttttaataaaactttcttacagtcttgtctctcactttcatgtctttcatctatcaataatgaatatttgaaaagacataagaagggaagtcttgggccctttattttttctattgattaccaattgttacaacacattaattgatgagaccattctttagttgagaatctgcaatgctgcctttgtaatatatcaagtttctatacatgaaatggtgtgtgtctggatcaatatacttgtctgttacaacggtaaattcgcccttctgtgaatcaacactttttactggccataaaatgcatttaatgtttcattaatgtgtttcactgtatagttcttgcatgttttttaaaaattttatttactactggataccatgtatctcataacagtaattttaaaatatattttgtttgtttctaataagtttaagtgcaatataatttttatattgatcttgtgataggccaacttgttaaattctcatgtttgttcagtaattgggctgtggattatttggcgttttctatgtagcaatcattttatctataattcatgacatttggggttttgttcaatacttatcctccttttcatttatgcataaatttatttctttatggcatagattatggccttcagtgcagaatagaaatagaattgtcttacacttgctatgaactgtagatttgtagcagtttattaaggaaagatgtttactgggcaacatagcaagaccccatatcagaaaaaaagcaagcaagaaagaaagaaagaaaaagaaagaaggaagaaaaaagaaggaagaaaggaaggaggaaggaacgaaggaaggaaagaaggaaggaacgaaggaaggaaagaaggaaggaaagaaggaaggaaaagattagcttgatagacagaagatacttctgaaaatatagaaaagcaatttggcaataaatctttataaaatatggtgcattttatactttattagggcatattattaatgatttaatgctgaattatgaagcagactgtttccacattatagttcctaatattgaaatcaactggctgttagcagtaggattgagatacagcacacacaacaatttatttatctaataccttggatgccattggtaaatatcagttgctagaatcacaaaatttcaaaaaatgttttttaatataaatttgctaaaatgtaatgttagcttgaagttcatacaagcaacacagctttccagggagtaacttgctccataaggtgagtgagagcccaaggtgttgctccaggtagctgtcggtggagagctgtggggtaaaataggcttgaaattgaagacagcaaccagacacagcctggggttgagcctgctggatgttatctactttaccttggggctacgttgtgtgtgtttattgtctggctttcccagctctgctacaataagctttgttagcttctgtgacacttacacaataatctctatgtgtgaagcccccaaagtgactttctgaaaagagttcacacagattgagatcggatgcagagcatccctccccagcatggcctctgctgcaccctgatgtattcacactcaccatgaagggcacaagtgccttttgatcttcaggaggagaatatgatcgccgaacaggttttcagttgtcacaccctacaatactctaattaaatggtcagcatgtgcctcatcagggtatccactcaagtaatctatttattggattattttaatatgtcagagttttgttcaactcgaaaatggccaatggttctccagaaaggcataagagctttgaatgatgcccccctttgtgtaatacatctcttcatgtaatatataattagcaataagaactctgtttatttataacagtaaattatttatttccaagaatcgagttcatgtgatttctaattcacgtcatcttgctatgaggaatggaagtctaatatttagatgggggtaaggcacccagtattctcatgcctttttgcatcctgaaagatatcaccatagtgtgcatttcagggtgaaggtgaccaccacgaccattcccttggcaaagagaaatgtccatttattttgtacaaagagaggctgaaatgtagagtccatgaactttcttctctttgtcaatgcaaggctcttgtttcataataaaataacatattcaagaaaagaattgtattgaaatgtcactctcatgtggatttcatgaggttctgaacttaaagtcttcaaaggaacagtggtactgtcaggtactcaggctttgcctttagatcacatggtttaaaagagaaaaaaaataaactgccagtgaacataggctctgacctctcttcacttttcatttttaacgcctttaaaaatgaaattatttgggtttaatacatgcataatttggaaatcccataatttggaaataacagaagtcatgtgctatagacttaatgtttgtgtctcctcaaaactggtatgctgaaatcctcacccacaaagggatggtatttggaggtggggtctttgggaggcgatgaggtcgtgagggtggagcctcatgaatgggattagtgcccttataaaagaggccgcagagagtgccctcaccccttccaacatgtaagggcacaataagaaggaattgactttgaaccagaaagcaggttctcaccagccactgaatctaccatgccttgattttccagcttccagaaccgtgagccataaatgtctgtttataagccaccccatctgtggtgttctgttatagcagccttaatgggctaagacaccatggatggaaaactaatcctattgatcatgatacaattttttttagagtaaattagggttttgaggctaatactttttcaggacctattactgattatttaatattgatgattaaattaggaagtaggctgtttccacattgtagttcataatactgaattgatcatttctgccaagcattttcctaaggaaaaacagtaaaagacagaaaacattataggtttctgtcctaagagctttaaaccagagaaagtcttattcctattaattagcacccccccacgcacacatttttttgactatgatcccaagtttccgggctatttgaatgtatacaattttctattaaacaaaggtctaatttaacttctcactaggcacagagtttttcctcattcttataggttaataagaagtggtgatagaaactaacatgagaaattattatcagatgtgagacaaacagacagaatgatagagagagagagagagagagtgattctgtttttccttttcttctttttctattttttttttttttttggccaggaactcagagctcagtccttagcttaaaattttaaaatataaatattcttcccccttatttttacttcttacttaattcctagtggtatgggatttcctttattcgaatcatttgatagcgagcattttcaaatatttgtattataaaatattaaagaatacaatgatatcactttacctgatatatcttacttaaaaaaaaaaaaaagcgactgaatctaaccttcaaacactcaagaattccggaccaaacatcagcaatccttttctgtaaagggccagagagtaaacatattttggctttgcaggccatatcgtctctgctttgcctactcagccctgctactgaagcatgagaacagctgtaaacaacactgaaaccaatggatatggatgtgatccaatgaagcttgatgcatagacattaaaatttagaattttatatataaaaaagagcagtggtgagggagatgcaacttctgaccctcgttgtagaccacaaccagtgtctaagttgaacaggtgccctcagaaaactgcatccagccactctagtgttggagggctctggacaattagaagaactgtgtatcctgtgtatgtcctgtgtatttacctcctgtgttgttctgtgtatttagactgtaagaatacctttgtctgtgcttggggttgggagcataggggttatatgtactgagactcaggtttgggaaataaatctcatatggaataacacagataagctcattatatcaagttgggaatccctaaacttgtattcaagaatgctgaagggacagctcaatgattcattaaggtgatgatttttctcataaaaccaaaagattgtttaggtttacttaatgagatactcattctgccttatttattttttaacatatgttttatcaaaaatacattgtttttatgtattttttgagaaatgttttttaacagtctttggccagaagttgttgaattccaccagacccaaaatgctaaagctctccaattcatgtttactctgccaccctcagacatctgctttcttctcctagcccaagaaactcttcccaagtgtcaccagcaactgcctgatgactaaattcaatgatctcgcctcaattctcaacatgtataatggaataacagcgacaggtccatgtttggaatggagagaggagactataattattatcattttacatcttgattggaagggttggtataatgtttttcaaataattgcctctgatcatcaaatacattgtttaaagattacacataagccttttttctctacttcacaatcatgtatcgattattcactgtgtatgctacacattgtggctgggccctgcagaaacaaatatgtcttctgttctctcacacataagtaattaacattgaatatactcttttcatttatttgagctgcattaaaatgcatttgataagctactatatccagttttattattataccaagagttttaaaatcattaaccattcatgtctgccgtgttcagaagccacggtgaacactttgatttaaatgtcagagttttgaaaatctccaaattatatgttcaacattgctttagcaaaatgcattttagagttataaattaacatacgtatcaaattgtcaaatacgttaactgcacacactttcaattaactcaccacttaaagtgtggatatgatatgaaataaatgaaagttgataattttaggattcattttgcaatgtgattataactctggcatttagacccaggtaatagataattaaataccaaaacatgactaccacatacatttaatcttgcaaattaactcacagaagatagcttcaaacgatgattgcatcatctgtaaatgactgtaatccaatttcataaatattgatgatgtttcaaaatttgaaatcattactagtgttgaattttactacattcatttgcatttccaaaattaaaattcttctctggaatttgggaaagttccattattaaagtgccccaaaataggtcacatgcaataatctaggtgataagaaaaaacaggcttatgcacagaatattcttacatgcattcaacttgatttgtctctcaagtttgcctgaaaaatctgtcttttgacagcctgcagacatagcctgagacaattatttgctgcaagcacacattcagcaatccaaacaaacttttggttatattaaaatagcaatcctcttatcacaaacatcagaactgctccctcgaaaaagtttgtacagagagataatggggccacaaattctgggagcataaagaggatggactttaatcaacctggcacctaactcaaagctaatatgatgctgttttcataggctgtaaagctatttgaagaaggtaactttcctctcacttaactttaaaagcacatgatttttgtgctgtaaagggtttcatttggttggtgtgtgttgtaagaagtttacgtttttattcgttgcacatgggatgcgacatctgatggagactgcaatccttttacggctttattgcaaagctggagaactatcagtcaagcgttgcctaaagctttttggctctagagttaagaaagtgtcattggataatgtctttagttctgtcgatattagacaattaccatgtattgacatttttctagggagagtcaagggagaggggtagtgaactgaatacattttattttgcaaatttaatgaaaagacttagggatccttactgctgttctttggtagaactctcatatgcatccatttatgtatgtagatatgtcatgaatttatatagccctaaaagaaaagaatatcagacttagatcacttccatttgagctttaaagctatgatagattttgtacaaacttgagcaaagactaagcattcccatctaagttggaagaatccagctgtgtggatgtacacgcatcagttgctgccaatttgaggacctgctcccacccaatcattttacccagacttgcaccagaaagaacaatgagtgactgcaaggaattttatccaacgaaagatgtaacatatgaaactcaagctggtttgcagcaaacatttcatactaggagaaataatgtagtacttgacactctgggtccaattgtgcccagatttggaaggatatgacctgattgtgtaagctcccctaataatgttggaggtgggaggatcacctgagcccaggaggtggaggctgcagtgagctatgatcacaccactgcactccagcctcggtgacagactgagaccttgtctaaaaaaaaaaaaagagtgtagcagttattagtattgcctatttcataatgtcataattctttgtgggcattttcttttttattttattttattattatactttaagttttagggtacatgtgcacaatgtgcaggttagttacctatgtatacatgtgccatgctggtgtgctgcacccattaactcgtcatttagcattaggtatatctcctaatgctatccctcaccccttcccccaccccacaacagtccccagagtgtgatgttccccttcctgtgtccatgtgttctcattgttcaattcccatctatgagtgagaatatgcggtgtttggttttttgttcttgtgatagtttactgagaatgatgatttccaatttcatccatgtccctacaaaggacatgaactcatcattttttatggctgcgtagtattccatggtgtatatgtgccacattttattaatccagtctatcattgttggacatttgggttggttccaagtctttgctattgtgaatagtgccgcaataagcatacgtgtgcatgtgtctttatagcagcatgatttataatcctttgggtatatacccagtgatgggatggctgggtcaaatggtatttctagttctagatccctgaggaatcgccacactgacttccacaatggttgaactagtttacagtcccaccaacagtgtaaaagtgttcctatttctttgcatcctctccagcacctgttgtttcctgactttgtaatgattgccattctaactgttgtgagatggtatctcattgtggttttgatttgcatttctctgatggccagtgatggtgagcattttttcatgtgttttttggcagcataaatgtcttcttttgagaagtgtctgttaaatggtgctgggaaaaatggctagccatctgcagaaagctgaaactggatcccttcctttcaccttatacaaaacttaattcaagatggattaaagacttaaacgttagacctaaaaccataaaaaccctagaagaaaacctaggcattaccattcaggacataggcatgggcaaggacttcatgtctaaaacacctaaaagcaatggcaacaaaagccaaaattgacaaattggatctaattaaactaaagagcttctgcacagcaaaagaaactaccattagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctccttgtgggcattttctgactccaggaggcacagattggcaacaccaggcagtgagtttgccagtgaacctcaaccagtgactgctggagttggcataacatatcccagctccgtagtccctcagcttggtcaactttgaggcatgttccagtctcttgggacactggacccttgtcctctgcaagggtgcccgcttttgaacataccatttactgatttacaggcttttctcccttccctgtgtcatctctccaagttctccttgggaagaatcacctctcacataaatgatgtgcattctaagccttgcctcagagtcaggggtaagggcttcattcagggaagttaaaacaaacacattgtgccctcgatggaaaattaagaccttctggattcagtgaaccacgtgaagacatccagcaagtgctaaaactgccacctagcaactttcaaattaacacctggctaagaaatgcatttgattaattgagaccccgtgtactgtccacttaactacacaattctattaaatgaagtagaatgatgatatcactttgatcctgcattttgtatgaggaagtattgattcaagcctctgcattgttgcctaaaacacacatacaaatacatattatctatatatagatatacatagctactttgctccatggagcagcacctgtgttatctaacttcaggtgtcacatatttgttgagaaaatagtgggctgaaaacttaatctgggctgcagtattaattgttctgattctatgaaccaagcaaaggtgatccatgttctgagtttcaaagaaacttctttggaccacagctcctaaaagtagactgtgcttaggtacttcaccaagaaaactcacaaaacccactgggattctgctttcctatgtgcatctagctgtttccagacttggggaagatgttcacagcatctcttagcctccatgagtcagctagctggaccagtgcaaggataccactcattcttctaaccctgtactgtgagtgctacacagccaaagttcaggatctcccataggtcttcagctgaagttcttggtaagatgagatttacaaatagggaacacgtgaacatcagcaattatggcaccaaaaacaatggcttggaaattgaaagaataagaaaaaaatctgcctcccagactcaatttcctgcagagtccagcaggagatattcaatatatggcatgaccctgaacgtagattgggaaaagccattttgtgagtacagacatttagagaacatagtccatgccacagtgaagacttgtcaggaaacatgacacactcaaattgggccagtgtaccacaaagccaggctacatgtctggatttttaacatcaaactgaacttccgttatttatctattacttattgttttaaattgacaaataaaaattgaatatatttgtggtatccattatgatgtttcagtatatgtatagacattgtggaatggctaaatcaaggtaattaacacatccattacctcacatacacatcactttttaaaataatgagaacacttaaaatctactcttttaacagttttcaagcagacagtacattgttattaactagtcaacctgactacaatagatctcttgaacttattcctgttgtctaactgaaattttttattatttgaccagcatctcttcaacacctcctcatccccaggccctggtaactaccattctactctttgctttaacgagttcaacttttagattccacatatagatgagaacatgcagtatttgtcctctgtgtctggtttattccactcaacgaatatcctctaggattatacatattgctgcaagtgacagaatttccttcttttttaagattaaatagtattgcattgtgagtatatgccacattttaaaaagtctattcatccactgatagacacttgtgttttcacgtctaggctatggtgaataatgttgcaatgaacatgggagtgcagctatcttttaccccatttttctagcaacaattatagtagcaacaacaaaacttaaaacataatgaacatttgcttttgtactctatttaattggggagcattatttaaaaggcattgccatctaggaaatcacgaatctgatttcccttcctttggatatatatccagaagtgggattgctgatttaatttcagattagtatttctatttttaatatttttgagaaacctccatactgttttccataatggctgtgctaatttacattcccaccagcggcatgcaagggtttccttttcttcacatcctcaccaacaccagttattttaattgtgtgtttgtttgtagttgtgacttgcaaagccccttacacgcaggtggcagtcaatgaataatagatggttcccctgagtgagagaatggagtgtgtttgtgtgtgtgtgtgttgtattccatatggtacctttttactaatccccaattactccattgtacatacactttgttttacttggttctaatgatataacacaaaagaacttatcccattttcctagcaacaataatagcagcaacaacaggacacaaaaaataatgaacatgtactattgtactgtgcttaattggggagcattattttaaaacattgccatgtagagatctctatgtaaagaacacaatttggaaactgatgaatttattctgacaacaccaatgctgccttatcaccatgtttcactctattttaatttatactagtccaataaccaataaaagatggtattccatagagtgtcccctttgaaaatgaatttttactaaataaactaaaattaacaactgatgaccataaaggtttatgagtgatagggatttaaaaatggatacctattgctttcatgaaaacagtttgataatgataaactgaaaaatttgaatacttaagcacaagcattttatgttctgtcattactaatacatggccagtacatgataatacttcattcagttttactttttctttagtttccattaagaacttctcatatttcctgttctctaaagcttgcatgagtgctttaatttctacagctgattggtagaaatacaaatgcctttctagtaaatgttaatgagcactctgatgacaatgttgctgttggtatttgaaactggcagaatcaatattcagggccctctggtaaagaggcaagcatatcggacttgaaattcctccaagtgatttcaacaacccaggacattccattaagagggctttcttatctaggggcagtcccatgacatagactccaagacataaagtgataaactttagtgaagttcattatctttcaactctattaaaaagtagctgacttaaagctaatcttatcaattatttatcattctttgcacactgtgagattgcctaattcccaagctctcaaatatgattgtaaaaattgtttgttttccatccaaatgccttcttataacaatcaattttatataaaaagaaatggtgacttaagtgatttttaaaatgaagtattgaatctcttttcccaccatttatgaccaagaatcctcagttaatgcttaataacttttattgtcaagacatcctttttaatttctaacctaaccttcccttgttgacatttaaatccatttattcttgctctaggaagattaagaaaagttggccagagttctcttcataataacccttcacttacttgatgacaattactgaatcacccttcatggtaaatgtctccaaccttctttgtgttccctcatttcctctcttactattgctcatatatgttattttagatgcagtaatagtataaaaacggggtcgattgagtgcaaatatctctctcttatcaccctctttacattaagaagttctcacatttccaattctctaagcttacgtgaatgctttaatttctacagctgattggaagaaatacaaatgcctttcttgtaaatgttaatgagcactctgatgaccatgttgctgttggtatctgaaactggcagaaacaatattcagggtcactgggtttagtctcctcctttcctcttctctggacatggcttcttagaaaggttggccccagtggctacactcgaattgtatgagcacttggtctcttggctatagctgatagactcaaggctgcacaggtcattcaggtcggaccactgtcacatgtgttcaggaaattgacatttgggattgagattccaaggctgggatttttggaagctgagttgtgtttgtggctactttttaggaggtgcccaatctcttcaggtgaggtctctggagttgtccttgttcctgagactcctggttgctgatttttggttttcttttccttcaaatttttcagtttctagtgagaaatctaataatccttccaataagttcctacttggggcttcagagagcaaaaactgatgtctacttcttgaagccaaaagtattctaactcatgttttgatgacccacctgtcaaaaaagaaaaataaaagtgcttcctggggttcccatggagtgattacatgaccacacaaacacctcacattacgtgaccctgttattctgagttaaaaggtgggactatccacatcccttcatgttatacagacatcagaggtggtacagataacagtttagtgaagtaacttgtttgtacattggtctcccatttcttgtgaggtttctgagggaatggagaggggtttatgagcttttgatttgtggtatccttcactggggcgaggctatggtagatttccaacacatttattaaatgaaacttttaacaagtcaaattagccccttgctagatccatgtattagtccattctcacgctgctataaggacatacctgagactgggtaatttataaaggaaagacgtttaattgactcacagttcagcatggctggggaggcctcaggaaacttgcaatcatggcagaaggggaggcaaacatgtccttctcacatggcagtaggaatagaagtataagagctaaatgaaaggggaagcccattatgaaactgtcagatcacgtgagaacttaactcactagagttaagtcactagaatagcatgagggaaactatccccatggttcaattacctcccgtcaggtccctctcagaacatgtggggagtatgggaactacaactcaagatgagatttgggtagggacacagccaaaccatatcaatccatgtaggtgatctggtcctttacaaagaaaagagcatttcaggcactttgactgcaatgttataaccaaaagaagaaataacttagtgcatataccatgaaaaatatttagggtggaggtatgatactatattgcaaacctatcatgagaaatgaactatgatggatgcattttacgcattatcactacagtaaggaggtttgtttggggaggttgagatagaactttttaaaaagtaataacttaaaataataaaagccttcacgagatagcatttgcacacataagttgtaattaagttgtgatcagaccagtaataaataataaaaagatattggaacattcactgctttgaaggttagaaggaagtagaaatagaaagcaaaccagcttctgttcctgggggagaagaatgcaacagaagctttgggagccatggagtgcgtcttacagatgtcaaccacatggtgatgaatggaactgtgcaatgaatggagaattacaatgaggcactgctgttaggttaaggtgcatataggtatctctgtcccatataattgacaaagattttttttcagacaactgaatcttattcatacctttattcccaaaggaagattaattgaattctctttttactcaaaggggatgatgtttaggactttatcacacgtgggtcacaataagttttcactgatgaagatataattcagatgagagtgtgagcagagaatgaggggaaattgggtgtatactatcaaggggtactgatatttaaaaaatgacattgttcaacataatcctttccattcaggcaaaatgtgtttcttgtgcaaaatagggtacaggaatgaaaaatattttattttctgcatctttggagagctaaggatggaatagaaagaaaagatgtgaaaaacagagaaattgtgtgggagaagaaaatattgatggaatgagtacaggaatgaagatgagggaaaagaagacagacgcagaatggagaccattcagatacaacaattgcagacaggcagacggacgatgctcatgtccactaagagaagatggtcatagacacagcgacctccgagaaggaaactttaagaatatgcaggcacaaattagcttaattcacatagggttagggaatatttctgtagcctggtggttaagcatttcagctgtgaggtaaaatagaccttagttcaagtcctgggtgacatcctggctgggcattgagtgacactgagcaagtttcatcggactgcctcaaatctcagtcttctcacctataaaatatatatttaaaaagcatctactcataggatgttgtgaattaagtgaaataatgaatgtgaagcccttcatttaatggctgacacagcctaactcagcagacagtatttcaagtgcttacaagtcagactgcagagagcaaaactagatgaagttttgctgaagtataaagggaacatgcttttcaaaggggagattctctcacctccaaacactgatacaccgtgcaggagacctctaggtgttggcaaattgtcacgtttttaagagatgctgcatcacaatctgactgttacgttgatttttaaatgtttacaatttatttgatttttacaaacatgttgcaggacaaatgaatacatcgggggctgtgaatatctacctgagcacagctggtgacctctgtattaaaaattatttttctcttatagtcactgctataatgcagaccactatgattactaatataactgtgattattttacttttctttttggggcaagtcactatcttggtgctttggagctaccaagactataaaaaaggaaatataatataaaccatcagagaagctttaacctagaaaataagttaatatgcacaaatatgtacaattaaatgatccacaaggtatacatattttataaatttctatgacagagggagatttctttttcgtttcaaacaaccatgattgtgttttcaaaaaagcagcccctttgtggtggtcccattttaaatggattttacattaaattaagtagtgcctctagaaagcttgacatatgctagttatttatcaatgtcattattggcatcattattttacatacaaccagacagccagcatatttgtgtacctcaggacttaaaactagcttgaaatatgttacatttcatcaaggttaacgagcttgacaccaaatatgctaatttaaaggtggcaggcatgtgaacaaaggaacaaagatactgtgtccaagaagtttgttgcaatgagggaataaaggaaaggttctaaatgttagtcaagagggccgttgttaagtgacttctagacagtagagtgctgttgttaaaaagagtaagggaataatagttactagttatatagcatttgttatgtgggtaacattcttctacttccttaggtgctttgatgtaaataatccttatacttagcctaaaaggccagtgatatttcatgcccattttacacaagaggaaactcagacctaggaaagctatcagtaattcacccaaaatctcacaggttggaagtgggggaggcagaatctgaattcaagcagtcaaaatttggggtcaatgcttctaaatgctatcataaactaatttcctagagctttttatactggtatacctgactcctctaatagtagtgagagttgcaaaatgaagaatgatatgtatgatgcaattcaacttacttaaataaggtagtaatacctaatacatacttatctgcgggttctgtgcctagaaggatacccagtaaactcttcactgaaagcactgtattccgagtctcaacttttcacttttgatgttcatttccttttgtcctgttataagaatggatttctgcaaggttcttcaattctcaagaattaccatgctctttctgagtttacttgtttatttatttaggaactcattgttttacacccaggcagcctatgttgttctccaattataacttccttaaaattcttgtaactcttgtgaaatttttcttctgtccttcccgttatttcgacttaaacaggaactgttggctgtagacatgagcctcagccttagtcctgtggactacacagtctccttcagtgaaatgcgttttccttttgccagcttgtaagaggtcatgtctggacccctattgggggcagcctgttggtaacccaggtagcagttgatggccaggaaggctactcttcctatggtctggctctcagcaaagtgaaagctgtggccaaattccccttttcatgtcttgggagacctcttccatggttccttggacataaaatggtgcaggatctattcagactcacatccactggcttgagtggcttctcaggtctccagtctataacagagagggtgcagaaaatcctaccagagaagagacttggatgcttttgccccaagttttaaggatgtattatcattcttctaaatcctaggttactgtttttgtttgtttgtttgtttgtttgcctggcagcacagacaataaatgctagattttcccactctgtcccctgaaaatctcaggccaattcaagatctaggacatacttttatacttttccaacataccgtggatgtgatattaccaaagaggaatagataggaaaggcagtgtccaagctaccttccttccataaggctacacaaaatattatccatggctacactgtcttaaaaatattccagcaaataaatgtatcctagtttgtttagtgtttctactcttgctagatgtatgataagctggtaattttcaccatatgaacatccttacccaaacgtttttattctgctttaaatagtttttagcatgcattcatataaatttggattctgagtcaaaaagcataggagtttctttcatttggatacatagttcaaaactggtttcccagagagttgtacttatttataggattgcctgcaatgttcagttcctgtagccattaatctcacccatgacagcatgagattccttgtaagcctcaattaagaaaagaattacagctggtggggccttcctctttcattttgtaaaatcccaatttttcctcataaagttcaaaggatctttttaataacaaacaaacaaacaaaaagcttaaagcaggaggtgggaaatatatgaacaattctcttaaaccaaagccttcccttttgtcttctttcttttgcctcaagatctttaaacagtttgcctcccatgggcttctccaggttttcctcttccctggagatttctagataccttaggggagagttgtttttcgagtggtacaacccatcggcaactgatttgtacagggaactggctgattctctagtacatttcagaaatgtgaaattgcttagggtcttgaggctgcattttaacttttagcagagtttcataatgaactaaacagcgatgttttgttctaggcacttttcattcacagctgagtttacagctaaaagatatttgcctaggcattgtggtgcatgcctgtagtcccagctactcaggaagctgaggtgggaggatttctagatcccaggagtttgaggctaccgtgagcttcagttgcgccaccgcatgccacctgggatgacatagtgaaaccctgtctctaaaaattttaaaaatataaaaaataaaaaagtgattaaattcaacctgaagaaatcgaagaatcttcgtccctacatttgagggctctaatcatatttaggatcaccgtgctgttgaaaaggaaaacctacccaggtgactaataagtgaaaatgtgttctctttgaaaatatttaaccacctttgtgacttaaattctattcgtagcttattttagtttccaggaaactaaatttcattaataagaaagaatttgacactaatttgggccccatgtaaattttgtttctgagattccctagtggtatgaataaacacccctccccatataaaatggagatccactgtaagactataagattcctctagcagaaacccaaccttctgtataatcactttcctttctgtgatatttcttctattacttttcatgaaatattttatgccatgcatggctcacagtgacaaagcttatagcacaaaaacaaaatagagatccagacactaacagaattgttgcaaaatggtctttgtaatttaatccactccactgtattatgatctccaggttttgctttactactccaggagatcttagaccccttttttctatgcctttaagatttctctcggtcgggagtgcaaatatttgtgaacttgccctatcacatttccacagttagcctcatcagacgcctagctgaagaaagtagatttttcatgcatagcctcagaaagtttcttaccagttctcgtcttctgagcccattctccaaactggcataaaaataatattcatgatatttttaatctgaaaccaagctgaatagacttctgacactccttccagcttcaagagagctattgttgcaccttaatttgagaggcaagcattgaagattttcagaaacacacagtcattgtatcagctgtttttttcatactctaagggaaatggaaagtaaacattctatccaaagtattatttgtattcttgcttgacagaactccaaaaagtctcaagaggcagatttaatatacaccttggttgagcgttgcagctccaatatatttttaaagataatgacaagaggccaggttctcagccccgttgcttgccaaaatggaagggaatgtctggagaggcttaaattccaagctttgggttcagctagactatcttcaccactgcagagtttctcagtcttgaactgttgggactgcagctgaataattctgtgcaggaattattattgagatccctggcttttctactcactggatacggttggtacctgaagcacctcctcccactgcgacaagccaaaatgtcttcaggagttgccagatatccccagggtggagggagtggggaacaaagatggccttggttgaaaaccatgactgtagtctgtgcctttccaggaatcacactagctacccatagggattttacagaggactcttcttcatatacttatatttaatcattttcttccttaaccctctagaactgtgctgtccaatgtggtagcatctagccatatatgaatgtttaaatcaatcaaaattaaatacaatttaaaaacccattctctagccatatgtggctaatgggtattgcatattagagaatatttccacatcccagcaaattttattggacagtactgatctaaagaaagcattcttagagggagacaaatcatccccaagggacaaagaaagggttctttcttgagaagggcaaatctccctctatttataaagcacaaatatacataatatgtgttttacttacacagtgtaaaatgtgtatacaacatgtctgtggtgttaaagttatctgtaacaggaatgagtttagaaaacagaagactaaaacccaccttacctggggcttatgaagaaacactggttatggatttattttcctcttttgagatataatttggaacttgaagtgctagatttgcaaatgcatcattgcggctttaagatcctttaatgccataatgaaacctctattcttattttcccttttacttatagctttcaaacaatgtaactgaagatacacattttcatttaacaacaactaaagaagcttgtggaattttgcaattgaaattttaagttactggaagctcctctaactagcttaatgatttctaaacaaaaggatcctattcaaaaatattagattcattttatatgataacatgtgtattagtctgttctcacactgctatgaagaaatactcaagactgtgtaatttataaaggaaagaggtttaattgactcacagttccgcatggctgggaaggcctcaggaaacttataatcatggcagagggcaaaggagaagcaggcatcttcttcacggggcgtcaggacagagtgagtgcaagcaggggaaatgccagacgcttacaaaacaatgagatcttgtgagactcactcactatcaggagaacagcatgggggaaactgcccccatgattcagttacctccacctggtcccgcccttgacatgtggggattatggggattccaatttgaggtgagatttgggtgggcagacagaggaatccatatcaacaggaatacaatgttttgatatttttaatttaattagaaaagaaagttataaataatattttgatgatgaattaattcatatatttggtttaaacaagaaagtacccaactcattgctggagtgatgggttatttgtaatggacatctgtcattattttctggctggatatctgaggtcctttttgggtttggggagattgttagtgatgagtcttaagggaaggtaaagctctgctttttgttaccaaagcaacaaggttagattctggttgtccctgacctagataatcataggcccatgacctagtattggtcatttggatattctgatccaggactttatagtgggggcagatgacacagagtgtgtcagtagcagtttgaaattttggtcagctgcataatgaccttgagtaaatcttcttgcttcttatgttagcaagtattgacacctatattttgcatccaaggatattatccgtaaaagtattttccataaggtacagctctggtaggagttccagggatgattttatgcagattttggtcaggctaccatagaaactcctagccccctctccaaattagtgcaagcgcaaatcagcctgagataattacatgaaagcataccatggtgagtagggcagaggaggtaaaaacttacaaataagaagctatttttctgccaaatggtccttaatccaaggaataatttctccaagagaaatatccaaatctgtgttagacaatcaacattactgaagctagattccaagtaatttccaaaggaattatacagtttcactttcccaccacaaatgtatctgagttccagttccttcacactctcaccatcacttgatattatcagtctttctattttagctattctgatggatgtatagtgttatgtacttccaggttttagcccttaatgctaatcatgttgagtatttcttagtatgcttatttgccatttgtggatattgtgtggcgaaatgtctgctcacatacgttgatgattttaattggatttttgcattattataagttgtaagagttcttgatgcattttgaattaagattttgttgaatttctgtctcttacagtctttttttccattttcttaatgatgtctctagaagagcagaagatttaaaatttgaaattcactctatcatcttttttatgatttgtgcttttcaagtcacacttaaaaactcattatataacttgaggtcacagctttctccttataattttagctttggggtttaggactgtctatgacacatttagagtcaatttttgcataagttgttaagttgaaacttagatttattaccttgtttataccaatgaatatgtttcaaaatttacccatatacattgttatactatgactagcagtcctcattcccttatttgattccacatatccatcttccatctgatgccatttttttgatgcttggagaaattctttttatattctttgtaaaagatttctattggccataaattttctctggttttgtttgtctaaaaaattcttatatttacattcattttagaataatttttgtgctagataaaaaattccaagttaattttttttcttttaatgtttcaaacatgctaatctactgtcttctgacttggatgatttctgacaagatatcttaagtgatgattatctttattcctctgcataaaatgtgcttttttcctctaactcactttaagatttttcactatattgctaggtttagccaatttgctaaggatttgacttgatgtaatttcattatattttgttcaatttggagtttgttgaccttatctaatcttaaatttgtaatttttatcaaacgtaggaaaccgtcaatcattatttcccaaatatttttctgtcccatttcaccattttctacttctaggattacaattgaacttttatcaggccatgtgatattgttccacatttaattactcctttctttcatggttttgtctctatgactcagcttaataatttcaattactgtgtcttctaattcacatgccttttcttctgcatcttgcaattaatcctgtgcaatgaatttttatttcagatatgttatttttcatctcaagtatttatattcagttcttaggcttccaattttttccttatttataatgatgctttcttttaaatccttgaccattttgaatataacaactgttttaaaatctttttctgctaatcccgtcactttaatttctgaatctgattctattatttttatcatggaaaatattttacattgtcttgatgtttggcctttctatacaatttttaattggttgtgaaacataatgcatgttatttattttagagtctaaatgttatcttcctttaggagtaaattctcacctgaggtaaattgaagttacttctagataggatggatgctttaaagggttgtttttaagctttgtcagggcattgctagagtaaccattagcctaggtttagtttaaccttaatactaagacgtggtcctaccgcagccgataataaggccctagttcttaattctatactctgaacaatttaaacttccacaccttattaccctgtgtacgctctggaaattgttccgcttacagatccctggagatttctgcccagactgatagagtttcatcaactatatgtatgtccttatttgtagaaaacacttaaaagaacctctatacagatttttagaggtctttcttcatgaagttttatgctttctagaactctgtcctgcaactcttgccacctcagcttccctgaactttgatctctgttttatcaactcagtgattgccttcctctgtttttaaagcctcgaatgtttgtccaggtgcaaagggcaattgtcagactcatacacataagagatcccatttctgtcttgatcgttgtacaacatctgaaagcaattgtttcatatattttgtctagtggtctgtttattgcttatccctttttttttgtctaaagcataaatcccactaatcctcacatgtttcttatataaacatatcctcagtatcagcattgatgtctctgagaatcttctcatttttcctatcttatttaaagtagccaccatgcaaattactctctaactctttgtctcattcaaattttcttataaaatttcacaaaatataaaaaacatatttcttacttattggttcaactctttattacattccttccccttaaggcactttgctttgcacatagtaggtgctctaaaaatgtgggaattataataagtacttaatgcttgatttgtggaatgggcattctaccaattaaatttgtaaacctaatcttatatattctttagtataagatcacctctttaaggctttttcttatctctgattttggcaagaggataattccatatgttttaactaaaaattacaaagtacaaaaataaagttcactggatgacatttatgcctcaggaaatatgtagaagattatattgtagtcattgtattaatcccacaggtagccaactgactttaatcaacaaatattacatgtcttttcctgtgtgcacagtgctatatagctgtttagtggaagtggatttgaacatattagacctatttcctcacaatgagcaaatgattcagaagcatggaatattataggtaaagaatccatggagattgctttttttttttggtcaaaaaatgggaatggtggttgattcgactagatggataaagatatcgtaaagataggctgatcatagtgtcttttattgtcttactagggaattttagttattttaattacagagaatttcttggtattattaagtaggaaaagagttagataagacaaatttcttttggaactgaattaagaaaaaaacaggtaagaggaaataagttaggaggctataatggtagcatgcacgacaagtaacaatggcttggttttggttggtgttggtagaatggtaattaatagaggcaaagctgaaaaaataaaatgaaaaagaaaaataaattcacttggaatcctatcagatataagggcctagagaaaagatctttaagattcctgatccaagagtttggaaatcaatgatgtcattagaggaaataggaaagtcacacccagggagcgtttggggaaaagagagtttagcaatgggcacactgagatgtcaacagcagtaagacattcaggtgtaactccccagcagacaggtggggatacatttctgattcacatgggagtttggttagggctagaatactagatctgagagtgatctgtagaggccacacagatcacttttataagttcctcccctttcataacatagtaagccaatcctcagtagcatggaagagctaaaaagcagacattcatggcataatacttataaaagtgaattaaaatgtatatgtctgaaattgcagactccctaaactaccaccttttcaggctttataatcagggtgtgatcattaagttccatctccttgcttacttgttcattggcacatagccatgtttatcttgtccggaggcacatcaacatgctgcttgcccagcatcgtatcttataacaatgattgcacattttcacttctgaccatgatccttgatgtctgttcttactcttattcagtagccacagcccaacctcataaagtagtggattatcaagaggggatagacagagtaggctgtttatcaagatttgatcccaaatataaccgaagtatatccttaaatgacttttaaaacctacctgaagtttggggccataaaacatatttatattcaatgtagttcaaaacaagaaagcctgtagaaaatgaaaagattactgtagttatttttcaaatcctaaaactttagattatcccataaattttgggttcaagaaaaagctgggaaataggttacaaaaataagtctcatacccagaattgccttttgaaatactgtgctaagaaaatattatggatgtaattgtcatttctttttcatgggcatgctgctgttttagatatattctttttttgaaatgcatgaagtctttctgaaataggtacagcacatcagaaagaaagatctatctaaaacttgaggttttaccatttgggcacaggatgatgccgggcacaggatgatgccagccacatttctttttggaaaattagactgagaggaaggggaagctcttttcctgctccttatctgggtcacagtaagctttagcaaggagcgggcaacaggctgctctttcagaattcatggtgggaagacactgggaccaacatactagaagtgttgggaataggggtggacaatagaaaaggggaacaaaggctcagacactactgatggggaattcttgaggatatgatacctaaaacttaccttagctcccatgactagtgcttaaggtattgacaacactcactttgtatgaactcctttccctttcacaaactaagatccagcaacttcctgcattgctgagactggctcttcagcaacttaagcaccatcaccataggcaatatctcctcctggtaggtcttttcatcaccgctggcacagaacagtaagtttccatacccaatgagtcttgtcaataattctctaccagcacggaagattgagagaataatttgaataaaataatttcacaactccatagctgtaactaattggactgactaaacagaatgtacagacaatagaatttactgtattttaacgtagttaatttagtcatttgatgaattgctggtggcttgtaaatacagctcatggttagacaccagaatcagaaagaaagatccaaaaaggtgtagtctctgaacatattttttaagggttggcaagcatttgttttagactaccaagacagacattaatcagagcaactcttctcaactggaggcaagtcttcctccaggggacatttggcaacatagggagacatttttggttgtcacagctgggagaaggatgctactggcatctaatgggtaaaagccagggatgtggctaaacatcccaggtgcacaggactccctgtgcattagatgcctgccaattagataattcagttgattagataatttggtgggaggaaaacaaaactagaaaatggccctttcagtaggccagtacttcccactttgtacatttgcacaagtgtagaatttaccaatgtccctttctaaaatatcatggtttttaattctagttgccaattaaagcgtaactaagatagaaaagctgagtatattcaagtattcttcatatttagtcttgattctctctacatttacctctcacctcttataattaattagttaatttcattatcagtgtgttctgtgaaccacaacttcttgaaaagccttttattctaagggaatcatattttttttttaactcgacatcttgagctaaaaaaaatcccattaatttctagtagtaagataaatgtttatggtttccatttgttgtcatcgaacatagcatagctcccaacatctgcttctcagtggaaatgttgattccttcttcatctcttcttaagaattgcataaaaactcaaatctttttatttcttgaacttccaagtgtttttcactttgtgtgatcattaacatgtcttgttttgcaccttggaatgttcaacttgttacctcttacatacctccttaagtgttatatatcgtcaccacctttcattctgtggtggagttgctgccacccatgagtcatggagcgtggagaggaggcatcacaaatggtaatcatttgcatctccagtaggaactagcacactcacaggctcatagtagaagtcttagttaagacatgcttgccggcaagtaaaagatattcctctaagcattctttggccaaacttttcctctatgatatttagggatttgaggacaggaagaacaacagaacctcatgggaggatgaagtcttgaacccgtaaggtgtcaaggatagtggagcaggtagttatgttccatgaccccctcttgactctctttaagaggcccatgaagttttacctttttttctctcttcacttttgcttcccttttctctctctgtggatgttgtctgcttctgcattctcccagtctatacatggctgtcaagatcctatatatgtcctgggacttctgaccaactaagtatctctgctgagctaatgtacctggtgctgtcctttttgagtacttggcattcattcatacatacatgcatacatacatacataaaatgagaaggaactaatgtgggctgatggcatgttaaaggagtatattgaaaagatagtgagcatctcacatcatcaccaggaaaactggagaaacaagcttggagtgtgggtggaaataatgggaacatttggaagacaggtccagcaggcatgaccatgaagaaaattataaccatggtgttcagcacaggaggctgggtgaagctgctgtacttccatccaagcaacatggatacatggcccactggcccctggaaactgagcgttgcaatcatcacttccttagctagcaggaattctctgtctttcctgattctttggatcaccattgacaatctcaatgtcctcttgggagatgtctggccacagagtcccatgccatttggcatgtcaaacatggtgatttgttttctgtaataagaggttacttgttttctgttaccatgaaaacaagaatggctggtgtgtcccaaatatgggacagggttttcaatgccaagtgataacagtgggcccatgcatacaattcgaggtaatcttatctcaaagtcattcttaattccagacttaatacaaaccttaatcccaagtgcaattttaatttccctttgtcatttcatagaatacatttgcaggttctgttgattaggatatcaacatctttgcggaccatgattctgcctacaacagtgatttatctagacagtgtggacataaaattatattttgtttaagagctctagatttggagtcagaagaataatcttgcatactgactccaatatctactagtgataaccctggacaatgattaaccttctccattaatttctttaattataaaatgagaattgcagcactaatccaatctgtttgctaatgtgaagctaggtagtttctataaaaggaatgaaaagcttccatggatattatacatgatgccattggaaccagctatatcttgctgtgaatggtgggtgtcttgttttttttagctaatgtgaataggtcactgaacttactgttcttcaatttctcatctcaaaaatgggcacaacttcacaagaaagttgtgaaaatcaaatgagacaatttaaataaagattcaaagcatcatgccagataaatacagtgaatacctaacatcagaactgaaaatacctattttcagtttatttacaccagaaattctcaacctttgcactactgatatttgaggctgtgcgtttttgggttgtgggggagctatgctatgcacagaagagtgtttcgcagcatccctgctctcttcccactagacattagctgcttccctcttcccctccccacccagttgtggaaaccaaaatatctctagatgttgtcaaatgtctcctgttgaggaccaaatcactccctctgttgagaatcacttacctaggcaaatacttatttaagtactgtctgttctttataacatttaatcggaagttatatatttagctaatatataaaatataagcatttatatacttacatcctgtcatatatttgtaataggtagcaatttcttttttctccctaccgtagggaaaaagagtaagtgtgacttctctaactttgttgttggcagcagataaatatctgatttgttcacgaccaaagagcccatgtttaacatcctgtttactttgggatattctttcttttttaacttatctacattcattttgaggcaattaccacaacatacttatcagtttaacttaatcaaatgtgtgtgtattcccattttgttagaacacaaatccaaaataacaagtgaatggagaaagcttatctttttctctaaaacctattacttctgctatcataaagatgcttcatgctgtgtctatctaaatgcaaaatgcacaggaaaactaaagcaagctcgatattttaattagagttaggcttggggagtgggatgataatgaccctagttttcacttttgacctgagagaacatgcgaattatatattctagtaggtgaaaaagggtcagcatgggaagtttctcaattaaatttcacaagattgtatagattgttgattagatttgcagcatgaaacactccagaaaatttacccaccagtgggcttaacacatggggaaatattttcagcagtgaggtagccattgcagtgatcacttggaccaagaaattgtttccacataaaccagagtccaagggattaaactgtagaggtgagaatggcactaaaccctgtggcacaaccatcaaaattaaagaaatggttagctgtctatgtggtgtccaagtattggcatcctatccaagcaaaattaactaggccaattaactgtaggacgggaagctcccagctaatgccatactctccagagtttctccagaagtttgtgtgatggctagaccatggtcagagagcaacacaaaatggaccaagctgagcagggagcttcaaggacatataatctggagtctaagaggttagatccaacgggtcggtaaatggtgtgcccagtaactgagggataggtgataattgatagagcaaatttagagccttcacaattggtaaagagtcttaacaaccatgtcgtcatccaagaaaattacatcagtcctggaaactgtgatcagaagcctcggagaggaaggctgtattcatcagggttctccagagaaacaaaaccaatagaaaatctatagctatatcgaaatctgtattgacgtctatctctatatctatacctatattgatacatatatatactgatctgtatctatacctatatctatatatccatattcacatctatacctatatttatatatctatatccatatctatacctatatctatatccatatctatatatctatatccatatctatacctatatctatatatctatatccatgtctatatatctatatccatatctatagctatatctatattcatatctaaacctatatatctatataactatatccatatttatatctagctatctactgtgggaattggctcatgaagttttggaggccaaaaagcccgactatctgctgtctgcaagctgcagacttgctccagctgaagcaagtcagctgaagtccaaaggtctgagaacaagagtcactgttgtccaactgcaagagaatatggatgtcccagctcaaacagagagtgaattctccctccctcgaccttttgttccattcagaccctcaactgattagatgatgcctgcctgcactgatgaaggtgatctttactcagtctatgaattcaaatgctaattccttctggaaataccctcaaagatacacccagagataatattttaccagttctctgagcatctcttcagcccgtcaagttgacgtgtgaaagtaaccgtcacaaagaccatgtcttcaatataaaaggactaaaccttggaaaagttaccaaagagggacacaagtcaagaggaagagtaagaaccacaaagagggaagctagtatcaggaagaaggtgaaatctagttttcagatttgaatcacaagatcagagatggaccagtgtccagtattcaggaaagtgctcaggtgatcttcaagatggcctgtcagacttgcagaatgtgaacttgggagctgctctagggtcagaatcccactgtggacaatatggactggttgtgcgttttgatcacaacctagagacttaaaagtgagtttgctaaaaatactagcctgccattggtcccatgcttaacactagcctgctaatggtcccatccaatgagaatacttcggagacaggtctagcaagcatgaccatgaaaaaaatcataaccactgtgttcagcacaggaggctagatgaggtcactgtacttccatccaagcagcatggacacatggtccacggtctcctggaaactgaacattgtgatcattacttccatagctagcaggaattctctgtcattcctgattctttggatcacgattgacaaactcaatgttcctcttgggagatgtctggccactattattgaatagttctatatttgacaaacatatttcaggagaagaaatcattacttttctacttaattttaatgtatatttgttttccaaagcatgaatagacttgggtaatattttacttgcagtaccatgtagacccgagataaaacatctctctccatataaatataaaaatagagaaagctgtatcaatgcaggactttttgtcagtgaaattattagtatcattctcatctcttgaataggaaattcagagactgtaagtaggccagagtcactgaaccacaaaatgcactctgaacgaaaataaccttgattatctttccaaaggaaagtaatgatgattagtatatgggtatgtgtcaggtatcgtctataagggtctccagaccagcctaataataataatatagaaaattagaaatgaagaggttaaaatgataatcaacagaggaggagaagagtgaaaatccattagctttgaacaaaggaagataactatatgtagtcccaaatgtatttacttggggggataaccctgcattatatccactgaagattattttgtgactcagcatctccaagcttcacaccagcagctgtggccttcgaagaggaaagaacaatggctctaaatcatcagcttttcctagtggctaaataaaagtgaagactgtgcagctaatgggacgggttgaaagaaaatatacagatgcaacatttgcaagagaaaatgagatcagattccatatctgacagacccttgacaaagtcttggtgggtaaattactggacgatgaagctagagacttgtggaagatataattcccccaaatcatcctttctcactgccatggtgccaggaattgtattcattagagtattttctttattttttgtttctttttatttttttagagacagggtcttgctctgttgcccaggctggagtgcagtggtgtgataatagctcactgcagcctggaactcctgggatcaagacatcctcctgcctcagcctaccctcacatggctgggactacagatgtgcaccaccatgccctgccaatttttaaatttttttgtagagatggggtctcactatgttgcccagtctggtcttgaactcctgggttcaagtgatccaccgacctcagcctcccaaagcactggcattacaggcacaagccaccttccccaaccactggagtattttcttaaggtcagtgtagcatttccagaaaggcaattttttttcgtaaacctatgtacatagcaccatcaagtcaacagtcttcttggtcaattgaaaaccaaccgggttttatattgacactcagaaaagtaccttgaatgcagatggctcagtgagagagggcagccaaggttagcttgcctgcttctgtgcaactgtgtaccaactatggcagaacttcccagactttgtgagctcatagtttctttagtgtctgagtaatttttttcctacttcccctaggccaaaagaaagacctaaaatttctgtttattagcccaaataagttacaagaaatttatgtgctaatattttagtagaacaattttaaaatcatgtctattaatttgaaagcaaagaagtatatttatatttcattcttgaatagccataactattgacaaatgaatgggatgtgcatgcctgttggtaccatacaatttcacaaaacttgaaattagattagactcacctgctgtattagtttgttctcatgctgctaataaagtcatacctgagactgggtaatttatgaaggaaagaggtttagttgactcacagtttcgcagagctggggaggcctcaggaaacttacaatcctcgcagaaggggaaggaaacatgcccttcttcacatggcagcagcaagaagtgcagagcaaagtaagggaaaagccccttttaaaactgtcagatctcatgagaacttactcactatcatgagaacagaatggaggtaattgtccccatgattcaattacctcccctccaccacacgtccctcccatgacacatggggattgtgggaactacaattcaagatgagatttgggtggggacacagccaaatcatatcacccatcctcattccctattacccactgatttgttaaaacagtatgtgattttttttatcccaccaagaggccaaaactcagttttgcaaagatgtggcactactgaaaaggatggagcatgatttaatgttgcatctcagaacaatctctatcatggtgtttgctgatatctgacagacatcaagtatttcagtgttttccccccaatttaaaataccttctgatgcctctttgggccatacattttctgtactattatggcaggaagacactataaatggtacaaaagccaaatgggtgtagttgtgtcccccacataattgttatttgtaaatatgcccacattttgttaaaacaggtattatgagtgatttggctcacaagtcttagtctgtacacccttgggcaaaagctttccatccagtatcgtatttgaatatctcaatggtggacagagcaattaatcttcattatttcatttaatttccataaaagcccaggtgctataatacagatatatgtgtgttctagatgaaggacccaagtcagtccttcatgtagaccctaagaaatgtaatttgctgaaggtcacatgtgattattcatgtggtgaggatggatattgtcttcaaatcaattcctgccaacctaccaagcccctgtgcttccactccaccatattgaaataagggctgtatccagttcccaataatttgatcttaaatttttgtcaagaacattagcttcctcagaataagttgaattaataatttaaggagagtgagccatttccccctatccctcccaggcactgtcaaatctacaaaaacatcctggaaatgaatgattctaggaaaacatgggatatcgaatttgcaggtttcattttcttaagaattgtgccttcattcgggaattacataatggtaaagggaacaatgcaacaagaagagctaactattctaaatatatatgcatccaatacaggagcacccagattcataaaatgagttcttagagacctacaaagagacttagactcccacgcaataatagtgggtgattttaacaccccactttcagtattagacaggtcaatgagacagaaaattaacaaggatattcaggacctgaacttagctctgcatcaagtggacctagtagatgtttacagaactatccaccccaaatcaacagaatatacatcttctcagtgccacatggcacttattctaaaatcgaccacgtaattggaagtaaaacactccttagcaaatgcaaaagatctgaagtcataacaaatagtctctcagactacagtacaatcaaattagaactcaggattaagaaactcactcaaaaccacacaatttcatggaaattgaacaacctgctcctgaatgactcctacgtaataatgaaaataatgaaattaaggcaaaaatcaagaagttatttgaaagcaatgagaacaaggagacaacataccagaatctctgggacgtagctgaagtagtattaagcagaaaatttatagcactaaatgcccacattagaaagtgggaaagatctgaaattgacaccctaacctaacaccacaattaaaagggcttgagaggcaagagcaaattaatccaaaagctagcagaagacaagaagtaattaagaaaattattttcttttcttaaagaaatgaattttcaacccagaatttcatatccagccaaactaagcttcatacatgaaggagaaataaaatcctttacagacaagcaaatgctgaggtactttgtaaccagcagttacaaagtaactgcatctttgtatgatttcacttatatgaggcacctagagtagtcaaatccatagagacagaaagtggatggccattgccagggacttgggggagagaggaatgaagagttattgtttaacagatacagagtttcagttttgcaagatgagaaaagttctggaaaaggatggtggtgatgcttgcacaataatgcgaatatccttagtgccactgaactcacttaaaaatgcttaagatggttatgttatgtgcattttactacaataaaaaaataaggtagaggatatgaagtcaaaaagcatgaaagagttttctaccaaagcagttttggatatgattggagttctcaaccaagctactccaaagaagggaaggttatttgctgatgaagttaacatatggctttttgtattagtctgttctcatgctactaataaagacataacagagactgggtaatttataaagaaaaagaggtttcgtggactcagttccatatggttggggaggcctcaaaattatgtcagaaggcaaagcaggagaaaggcacgtcttacatggtggcaggcaagagcttctgcaggagaactcccatttataaaaccaccagatattgtgagactaccccaagaacagtatgggagaaactactctcataattcaattatctccactttgccccacccttgacacatagggattattacaattcaaggtgagatttgagtggggacacagccaaaccatatcacttttaaacataatcttaattaaataatcaattacaaattcattcaaaacataaggcagtgatcccataataacactgctgaaggagacccataaagttttaattacactcaattatcatttctattgagccaacagattcaaataaaagggtatgggcgtgcaagagacacttgatctgaggaaccatgcattattttatacatattgcgcaaaataggttaaaatcaggatgatgaggtaatttgcaaactttttgaaatcaatctgtgtatgattgtctttttaaatgtctccttggatcattatactctttgagatattttcctctctgagaagagaaaggtatttccaacactgtaaatgctgtatttcactgatgaactgtcccttccaatactttgaatcttcaattgccctgaaatccatatttggtagataactgggcaacatgagttttcccattgctgtctttacatgactcccaggcatgccacgaatggcttccatgttagtaccagcatctagatgaggcaaacacagtggcacctgaaaactcagagatgccagcaatcacggagcccctagaggtgttatagctcttgctcagggagccccgaggtccaagccctgaagaaatgtggcagctcttcacccctgtagcctggcaagcaagagcatgctacagctctctttctcctgtcgtctggcaagcaggagcgtgttacagctcttttattcccattgctcgcagctcggtgagctggccaggagcatcacagctctttcattcccaccacctgcttctcagtgagtttcaggttcttgtcccgtgactgagaggaataaggtacatggacactagcgagtgaataaggcagagaagaattttatcaagtgacagaaggaaagctttcacctgtgagaggagaacctgaaagcaggttgccatctgtgaggctcagtctggggtttttatggacctagaatgggggagagtgtgctgattgatccatcggtgggcttggcaaaagcaccattcaattggtaaaaaggcattatccagaaggaaacaattgagagagagagggtaacatggggatagaagttctcgctccagtcgtggactctatccggaaccagataagctcagttttcaggtttaaaccatctttggcttgaaggtcgggtctcacctctccttgtctgcctaggaatttgtctgtctcctgtcactatcatcatcacactatccccactccatatgtacacttttacccttcagtgtgactaaacaaaaggattcaaagaaaatataaatacatttctccaaaagtctcttccttttacctatacatacaatgttatctgtagcagataaaatacaccatctgataagaacatagaatggtggcagaattgattttagatttcttctgcacaccctttgttttctcactggggaagacgaggccatagagctgaatcaactggccaagttagtcaagattctgtgaatccccacattaaattctgtgcacattgctataatggtttccattgtggatttcatgcatgcatgtcctataatataacaagttcattgagtatgtgacttacttggtttgtgccatagtagtgtcttatttaaagaagtacaatccaatcacaaaaacttactaaaaacgacttctattctttaactgtgtctctctaagaatatttaaaataattcaatttgtggtgtttcggaacacttttatttctttgtctcatcccatattctgagacctttctttcaccatgcctcccaatcatcccttctgtctcccatagcatttaaatgctattctctcttcccagctcacacatctactgaagcagaacacacatttttattgaagtcatactggaacatttttggcttagttttactcttattgggtcgctgttttcccgtctaaagcttaaaataggtttccctggctttactgatcttctcctgctttgaaattatgaattatacaaggtaaggtgagaaaagatgggctaaattaagcaaactaacagctctctaaacgattggtctaaaggatgtccagaatggaccaacacactagtgctggaagttttagatttcaggctcttttgccctgacatgattatcaatgagttgcgtgcaaggacatgagatatcaggagctttcatgtcatctgagacttagatcacaagcatctcagcagaatgaggtaggttttaaatagcttcctgacagctagaataacgacaaagtcataaggtccactaggaaaggattgaagacatatccaaaaccaaatacaagatagcctgaaaccaggaaagaaaactttgcagtgcaatgagaagtatcttttgacctctgggaccttagggactgaataccagaagccaagcaggaaatgctgtgcagggattgtcctccagttgccgggaggacagcaagccaggctggaaggggtaaagcttgaacaaacataagcagtggcaatctgagttcatctcagaaaagaagggttatgtctttgtttagaggcaaagcaaaagcacccggggcctagatgctcacaaatatcaccgaccaaagtatattttagctcaatgtcagttgaagttaggatcagaaacaaccactgctactctgtaaatttttttttctttctcgctctttggggagaatttcatgtttacccttagttgtctgataaaaactctgtttgaacatttacaatcttgtctcatatcaactcgtcaggatccaaaagatatcgacagatgggaattatgaatccactctcccaagaagaatgatgattgtatgaaagttgcaggctttgctcaggtggcttgaaaataactttgaaaaaaacagattgtgaatctttagcacagaataaggaaaaataaaaaacagctcaagtatgttattatttaataaatggaaaattaaaagtatctaaaaaaatagctgagataagatttcaggcttcattcctagaggttggtgttgaccaagttccattctgtgcaggttggaacgcatctgggagtattggaattaatcacttggacaagagcccaggcatacttgaacacatttaagagaggatgaccatagtgtgttgaagtagctgaatatgatgatatcaaagcatctgagaattttgatcttggagaaaaaagactggggaaaatatagagaagcctgtaggagatgtgattttgtatctgaagatcaaccatgtagaaaaaaagttagatggtgctatgatttggatatttgactcctccaatcctcatgttaaaatttgatccccagtgttggaggtggggcctcatgggaggtatttagaacatgggaacagatccttcatgaatagattaataccctagttgagggaagagataagtgaggtctcactctctttgtttccagaagagctggttgttaaaaaagcctggcacctcttgcctctcttgctctcttgcttcctctcccaccatgtgatgcctgcacacaccagctcccttttaccttctaccatgagtataagcagtccatggcccttgccagatgcagatgccaaaactcgaactattccagacatcagaattgtgagccaaataaacatttttctttatatattacccagcctcagatacttcatagcaacacaaaatggactaagacagatggcttgatgaggtggaaaagatcttccccactaggctttgagataacagggcagcctcttagaaggaagacggatgtgtcagtggtccccaagaccatgcccacattcaatgatttggtaagactcacaggactcagaagttgttatactactcatacttacggtttgtgatagtgaaaggacacaaacaaaatcagcacagggaaaaagatggatgggcaaagtgcaaaggtgcaagggaaagtagacacaagcttccaatgtgcaagggaaaccaggcacacttccaagtgtgtcctcccagtgggtgcacttaatacctctggcaatgagttgtaataatatatccaaagtattgtcaattgggaaagttcactcaaaccttggagtacagagtttttattggagggcagacacaaaggcacataatcaaacatgatttttgaatctctagactcttagaaggaaacaaaaagtgtttaccacaatgcacaccgcttgcatgcactatatacacaatcttgtttgtatggttcaagacactcctcccactcaaagcatgaaaagccctctaatcaatgggaacattctaagcgcttaaatcacaggaaactaaccaaggcccatcactaaagtgggactttcttgggaatgtgcagggtttgagcaacccaggcctgctgtgttaagtctttcctgtataggggacaagggtggtgagtccatggtgggggtgttgtgaaaactggctcctcttgcctgcagccacttttttttgtttgttttgttttttgtttctgtttgagatggagtctcgctctgtctcccaggctggagttcagtggcacagtctcgactcactgcaacctcagcctcccaggttcaagcgattctcctacctcagcctcccaagtagctgggattacaggtgtgcaccaccacacccagctaatttttgtatttttagtagagatggttttcgccatgttggtgaggctggtctccaactcctgacctcaggctatctgctcacctcagcctcccaaagtgctgggattaccagcttgagccactgcgcctggactgcctgtagccttcttttgtctggttctttgtgcaaaagccaggggaactggagagagattcattttgatttaaaaatccttgctctgtccttgctctatgaatttgaaataagatactttactttggtgaatctttatttttaattagagagagagaggagaaaaaaaaccacgcacgggggccagatgcctccagccaaagaaggtgaggcatagagatctcttaccactaaggaaggtatctgaatcatgtggcaccaaatatgtcactggtggaagttatccaagttactggcggcaaatccatatggatctgcagcaacctcaattcttgccttctcggaagaaagaattcaacggggggcataaggcaggaaaaagatggaggaatgtttcagagcaggagtggaaggttattaaaaagctttagaacagtaaggaaaggaaggaaagaaaagaaaggaagggaagtacacttggaagagggccaagcagctgactcgagaaaccaagtgcactacactttagtgaatcatgaaagaaataattaacattgtttataaagtgtgcctggcagatgttatgtgaatatttgttttcttttcccctgagttggggaaggtgagattcctggtaaatcatcatatttattccctcacccgttctaaaactccaatgtgtacatgaaatatctggggatcgcattaaaatacagattatgatttggttgatttggagatgggccccaaactctgtgattttaacaagctcctgggtgatgttggtgctattggttcatggaccacatgatgcccagggtgggcagcactatgtcatgggggaaaccagggagcaggtttagtacagactccttatatttctaccccctgacatcttctcttgttccattcccctcacctcaacctagtacaacttagagtgttccagggcagtagttttcaagcattgctgtttgaaactatcaagaattacctggctttccagttaaaagtgcagattctgggtccccactgcactgtggtccaattctgagatgaagcttgggaacatactttttttgttgtgtttctaaagtggaaccctctgtgatctgatttaggtagtggagaccccagaatctctatatgaaggaggttgggatcatcaatgtgatggaagggagggcaaggatgctgcttagaagctgtgtttacacagcaagcacctggtttctgatggctcagtgtatttgtctgttctcacactgctaataaagacatacctgagactgggtaatttataaagaaaaagaggctaaatggactcacagttccacatgactggggagaactcacaggcctggcagaaggcaaaggagaagaaaggcacatcttacatggtggcaggcaagagagcatgtgcaggggaactcccatttataaacccatcagaacttgtgagacttattcactaccatgagaacagtatgaggggaaccacccccatgattcaattatctccacatggccccacccttgacacctggggattattataattcaaggtgagatttgggtggggacacagccaaaccatatcactgagattgtgtatttgtttgggtgactcagagggatgtgatggagatttttgtgtggtctaaatccttttcaagccacccctcagtgcagccactggaggcaggccatctgggaaccacacttctcctcactccagggaggagcaggggaccaagggaccctagacaagctattttactcttttaagcctagtttgttttatcagttgtaagagagtaataatgcttacctggaattggattttatttcattttacttttatttatttattttttagagacagggtcttgctctgtcacccagagtggggttcagtagtgcaatcacagctcactacagcattaaactcctgggctgaagtgatcctcccatctcagcctcccaaggagctgggactacagacatgtaccaccacacctggctgcttttaatttttttttctttttttttttttttgtagagacaggggtcttgctatattgctcagtctagtctcaaattcctgggctaacacagtccttctgcctcagcctccaaacgtgctgggattgaagacttgagccatagtgtccagcaaaaatggaatgggattttataatcaaagagctcagaggagacacccaggaaattatatttgctctttttattggttctcttatacctgactggagtagggacttcacattgaaactaatgtaagtgtgtttgacatattactctgtctgttctctttctctccttcaagaatgatgccaggaggattaataggtggaagtaatcagagctctggtttcatggtcatgtcattcgttcttccagcagcttgtatagtgcagccatcaaaagtggtgaggaggctgctctggagctgtgcacacctagggtggaaaagctctgtctagatttctcattccaaggttacctgcccctccaacattaaagggagaattggcacggaatcctgagatggaaagggccttggaagttccaaccccagatcttcctttgcttgtacagagaaagagactgagatcaggaaaggtttgatgatgacgtctggcagtattaggaatacaaacttatcccctttgctctcacacaattgttttatgcactgcaccattctgcttccctacaaataggagcaaattagctcccaccaaaagagtacaccctgtggggaaatgactggaaggtcaataatacgtatttgtattgacttaaggaatagtcaagctgctaaaagggttgatgctagttttcttcccttgacgtatttattaataatttaggatatggggaaaataagatgccttctggaattgatattagttgtaaagcatcatatatcagaggaaaagcgaagtaaggccaggagaccaaaatgttagattgtgagattaaaataatgctagatcttcaaatgggcaaatgatgcacagtgtgagaataaataaatacctgtatgttgttttgctttttattgtggtttatgtttatggttggattgcagtggttatgttttaattatctaaaaaaaatgataccagttgtcctctatccaaatgaacattgtctatcaaagtggtcaacttctaaggctacgtgcttaatccaatgatgttggcactacttaaaacatttttaaatgcctaaggcattttctttaaatattcctattaatggcagatttttgtagagaatcaactatgtttggtatgatgcaaaaaaatctttaggagaaaatgtgtgtccctataaaggttgtggaaggttgggaaaatcatttggagtaaaacaaaagaggagtagattactgaaaacatgacgatgttttcgaaagcgatccatatgttctaaaggaacagtgggatgatgtgatgtgagagaagtgctcatcttccaaatctctcccagtgactctaccttagtttgaatgtgaaacagttttaaaggcagatgtgctctggactgcattcatcaaacatttagccagcactcttggtgcaatgatgcctccattgtctccactggtgaaagacgtgtgtgggcagaagctgagctattgcaaagttcagtgattgctacctgtggaaggtggtgatagaagtgtcaggctgatgtgaagacaggcatggcatggcctaagatctgcccatttaatctggtgctcccctctcttcttgatgcaaagaggaaaaggagatactttagtctcaaagtcaaatcagagtgatgcatggagacagttaaatgctgtttgcctctgtgatgccaatgagctgcaaccctggttttctattctttgctcaacaccagaagttaaggctatgggaagggatgcatcacggcagctgtacactgagaatgagcccagaggagagctttttagaagcatctgctcgtctttatttgagaaactcagccctttcgagtcgcttggatcaagtatagctttctaaggtgagaagaaacttgaaaggcagttctgatatctaatatggaattcttattattgcataggttcatttcacgtcattctagaaagttataggtgcatttcacggttcaaaagtagaaatgtcaggagaaaacatcaaaaagagaaatcccattttacactgatcggagatcacagggtgtaagatgaaggaactgagaagtagaaaaacataacctcactcacctgcccagagttgctgcttcctgctggctggggtgccttggtttgcattgtatatgacctctctccaagagtctacacttgtcttcctcagtgtatggtggcctcagagttcctttaccaggggacaagagtgaaagctgcaaggtctcttaagattgaattcccagacttcgcacagcatttactctgccacattctgtgtgtcaaagtacataacaagcctattctcagatcaagggcatggaaatagactctgtgtctttatggtggacacaggaaggtgtcattcatcaggcattattaggaaggcaatctgcaacatttctttctgaattgcctcaaagagaacatgactggcatcttgatttctgaagtccatgtcttaaatcctcacatggttccttttgtgacacagtttctatttattgaaaagctaaatctggaagaaggaaatcataaaggaagatctatagaaacatttattcttgaatatatatgtatgtatatatcacaaaaactacgggttttgatattctgcagttaaatttgttcatatggttgttcatttaatttacttatttaacatatttcaataagtaatacatgcacatggcagaaaattcaaaggtacgaaagggcatacatggattgaaaagtaagccttttttccatatcatttctctctaccactcagtttcaccataagaaaccatattgctctatttgtagaaaatttggatttatatcattttattctattcaaatcaaatactcaagattaaataagaaggagacccatagagatggggaaaggggtatatttatttgattacaacaaactatgaagtcatcaactgactgtaccactttctgctgcctcacagattaaaaacataaataacagaaggagaaagaaaaaattgtggagatgtatacaggtaagaatctaggaagccccaccacaacccatcctcctgacttgcaaaatgcccggcaaggtgacagtgtggaggatgattaattatcactctggtatccccagccatcagaaagtgccctttttaaaggacctataaaatattaataaggtccacaagtttatttagctaatgtgtgacaccaatacattgtatcaccattagtttttgtctgcgatgctacaatgtgacttataaggcaaacatgactactgttaagatttaggaaataggtatgagcttggtggcaggcaggagaaattactgagaagatgacagtattttcaattcatttcagtagcatacttggtgcagaagccaggttgtggagaattgagcagtaatagctcaaggacaagtaatagacaaccctgttaataagtttatctgtgaaggaaagaataatagctacagcaagtcattcaatcacataagtgatgttttcatgggaaagacttgaacatcagccttacctattgctacaggccaacttactcttggagtaaagcaagctttatggagagtcacatatatatgccaccccatctttagtagacaccgcaggctcccatgatctgagtcagagatgacaggggagaagctaagaattgtagctcgcatttactgaatgtttgctacacgctagaccctgtcttgtttaatttacacaaattatgccattacaacttcacagcaatccagttgggtaccattgttgtacctgtcctacaagcgaagaaactgaggtctacagaggttaaaaaatttcctgaaagccactcaactaatctgtgacaaggctaatatcagaccctgagtagcctgatgacagaagtcaccatgctatacaccacccctgactgagcctcacacaaaagaatgtcaaaacgtgcagggatatttgaacatatcaaccaatcttgttgtagccataaagtccatgaatgtagaggttgggcccaagtgttctcctttgtctctccggttccctctcacttacatatttcattgtagatacaattaaccttcttatgatcagacaaagctcttaaagattccagagattactcaatggtgcaacttactctgaacacaacacaaacttatccactccatgatgactgaaaagactaaacaagagaactctgttctcttcaatgtgagagggatgtctggagcagagagaagtcaggttggtgtgatgattaaattttacaagtcaatcatggccaaacaccaatttagatattgctgcaaaagtatgttgtagatgggattaacattccctatcacttgacatcaaggagttgaccctcaatacatggtggcctacatccaatcccttgaagaccttaagagctgaaacagatttcctagagtaaagaaattcagcctcaggaaattcaagacagtaacatagaaatcctgagtttccggcatactgcttcctctacttattttagacttgccagtcctcatcatcaggtgaaccaattccttacaagtaaatgtcatcgatggatacatatagaaagacaaaaacgtacatctgcatgtgtatttgtctatctatctatctatctatctatcatctacctgtcaatcatttctcatctatctcttgctatttatatctacttatccatgtctatctatctatctatctatctatcatctacttatctgtcaatcatttctcatctatctcttgctatttatatctacttatccatgtctatctatctatctatctatcatctatctattgatctatctataatctacctatcatttacgtgtcaattgtttgtcatctatcacttgctatttatcatctacctatccatgtctatctatctatctatctatcatctacttatcatctacctgtcaatcatttgttatctatctcttgctatttatcatctacctatccatgtctgtctatctattgatctctctataatatacctatcatctgcctatctgtcaatcatttgtcatctctctttagctatttatcatctacttagccctatctatctatctatctatctgtcatctatctttcaatcatctatatatctatctgtctacctcattatctatctatcctattggttttgtttctctggaaaactctgaccaatgcagtcagtgtgaagggacagatcaatatgactgataactcacaggtaaaacttatatttatgaaaccagctttctttcacattgactgttacttgattactcacacccagggcttctatctggatttgttcacagtgtttcctttatcttcagtcgctcttctcttttttcagtgtttttcatcttcatcaacgtagatttctttttgtctcctggtgggttttctttctccctgatatggtttggctgtgtccccacccaattcttatcttgaattgtaactcccataattcccacatgttgttggagagacccagtggggggtaattgaatcgtgggggcaggtctttcccatgctgttctggtgatagtgaataagtcttacgagatctgatggttttataaaggggagttcccctccacatgctctcttgcctgctgccatgtaagatgtgactttgctcctcattcaccttccgccatgattgtgaggccgccccagccatgtggaactgtggaactttataaattatgtagtctctagtatgtctttattagcagcatgaggacagaataatacactttcctaatgtttcattggcactttcatgttcttttaagtattttatcaggcttatccaaatttatatagttcctagaattttaacttttgattaaggaaatacatggtcagaaatataacattcttataaaaatcactacttaccagtcactttaatatatcaatcaagaagcattatttcctgtgattcaggaggtgaacacttgttttggctacaatgaattcatgtgaaaacatgtacaatccagtgaaacgaattattacgcaattaatatctgaatgcatttgtatgttttttggcttaccacctgtctctcaaccatctagccatgcatgaatactatcaggcttgtcttatttataataggaacacctaatcattgtgttattctaaatttttatttgtatttccagattatcaacccacctgctaatttagattattgtttagaaaagcagcatagctcttttattttatcaaaggtcattcagtaaatttaatatatttgatgccagaaaaagaaatctctttacacaaacataccctctacaagttacaagttaaaagcaatatttatttaaaatagcaaacaataaacttttaatcgctaccactgtcttacattattttatgcaatatgccatagctaagaaaatcttctctacttttttcctatccagttagtgaatacattttaagtattaaatggaagaattagattcttaggcgagacagaatacatataaaaagatgttaatatttaataataaaagttgaaaatatattacaaaataaagtaagaaattttattatctccaagagtatcctttttataaattatttttcttggtttcttgtgctgtttaaattttcttgatttctttgcaatgatattgctttgcagatacctgaattatgtcgtgtctacagatcccatgagtatgtagccatagcaatgaacaacacaggtaatggttctgattttatatggattcatgaaccctcgaaattagacctttcccattttaagaaaaaagaaagaaacatctctacctataagaattaggtatatatagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaagaattaggtatatagaatattttacatactatgctcatatgtacaaaatgagtagttggaagtaaatgtgagaataaacagtatgcagtggatgaaacatatattctagtttgaaaactcagaagtgcacatttaaagagaaaatctataaacctgactgctttacattagtggaaaaagtagtctgaattatgttacaatttgcaggtatatacatatttattactttaagaacttgcacaatatgtaaagaagagctttgctttacatgagtaacattttactaagtgatgtctaaatcatcatgaattctcagttagctagagcagcaataatgacattttattgtaggagaggaatatcctaatgaatgtagcttaatctggtattttcagaagtggcttttcatcaggtgtagaacctggattaacagctgattttgcctacatcatatttgattctcagaaaactttccagtatgatagataaaaattataaggatctgatgtaaactcctgaggccataacttatgcccattttctaaggcaatacttaaaacaaaaatttttaacagcaataaactctgttcttgtgaccacctcattttcctcctcaaaattcacaacctatctccattactgcgtgactttttgttttgttttgttttttagcgacagggtcttcctctatcacccaggctggagtgcagtggagcgatcatagctcactgaaggctcaaactactgggctcaagtgatccccctacctcagcctcccgagtaactgaaactaccggtgcgtggcaccctgcctggctaattttttcttttttttcttttttttttcttttgtacaaacaggttctcactacgttgctcaagttgatctcaaactcattgcctcaagcgatccactcacctcagcctccatgctaggattacaggcatgagccaccacacccagccctaaatgacatttaattttggaaatctcccaccaattcaatccagcctaaattatttgtaccactctttccttttgatcatccattatttttaagtatcaacattcaactctctatgtttcctcatagttttgtatattacatcccacttcgtttatccctaggtcttctcaaacaaattaccagggaatctcctcaaacctttttgcagatgtctcctcttgctcctttccttcctgtttctatatttgtcatttagaatttgagacctgctaaagacaaaccacacatttcttccagttcctgtgtgggaaggtcaaaggtctatgtgtgtgtcttactgacatgtcctttcctgtaaacgctgtacctggtgttcccataaaatctggcttcttgaaaatggcaataatgactgcattcatgtgttgagtgtgttctctggatcagtcatttcattgggttcttggaaagtgcgttttatctaattgtcacagatacatgacaaggacagtgtttttttcatcatccccattttatagatgattgagctgaggtttctttgagttaggtactggacccacagtggaaaaattagttcttcattccagataatgtcttagaatttttccagctctgatgttcaaaatttaaattttgtcatggaaataaagtaacatgaatctccactacagaagtggcgaatagcttagcttggttgaagaaaagtttgcattctaagctgacttcacagattgtagaatccactgaccttctatagaagaagtgaagaaagtctgagaaaattccccacaatctctccttgatttcttccccatgagtttgcactgaggaccaagttccacctctaaagacaaatcttatggtgttgaaacagccttttcccaagggaaaattgagtctcattttcatgggatgctaattttgatgctctgaaaaaaaaaaaaatcctatttggtggtcaaataaatttgagagtcctggactaaataaaactgaaatgagttttattttttgttatttggggttttttgtttgttttttttaaagccatgtgttcatagagtatctggtgtattcactcctgtctctgagagggtgacatgatatacatgcattgacaaatttatcagactgtagaactccaaattttttttgatgcacccaatacctattaataaatctcaaaagtgtttatctaagggactgttatgttaagatttttttttagtatgccctgattaatgtacaaataccccaaaatgactcatagaataagccaatggcctcccctcagcccaggattcattggctgcacactagaatcacaggaggcctcataggagctttagaaaacattgttgccagaatctgttgaaatttttggaagctgcccaggttattctaatgtgcagccaaggttgagaagcactggcttaggctgagcacaaaattgggttatcggagtgctgtgcaggtgtgcttgggacttgtgggtggactctccggaggcaagaattgggaggaagaaattaatagagatgaggtaatgggtgaaggagatccagagtctgaggaagcatctatgagggaaaagttaaaaccctgcatggactttagagaacaaaaagggttttgagattggcataggaagtattgaaaaagagaaactttaaaaaaatgaagggaatacactttcttcctacatattatacttttgctgtctgcctgccagtcccagctacttggagacaggtagtgaggtggatatttaactcgaagtatacacagttagcaagcattacaatggttctatctttgtgtgacttacactgtgcctatcacatgtcggtatcaataaacattcatggaagtaaacagggagccctgatttttaaactctaaattaacacttgacgttaacacacattcattaagaatcagcagcatgctagtcatgataactgttaaaccaattccaaattatagattttactcctatgaaattgcatatctctagcagtgtgtgcaagccacaaataatatgctttctctctgcctgggcactgttatattcattaaaatgcattcgatttctctttaatttgtaaactgaagcaagcattcaataagattctctgcaacctatttattcacctgcctttgcagttgctgtgcaatgtcattcctctacaagaaatggatatttcttttccaatctttaataattaagcaagtgtgattttcccctcttttagttgccttagcaccctctaattgggagggtctattttgtattctattatttcacttccatcccctatttcctcatgaaataaaaatcatgtgttcaagtaccttgcaaaaagtacatggtaagctttcttttaaaaccatgtctactttcagagaagaagctttggactataaatatatttgagtgagggtgaaaatgcaaaaccgatttggtttttgcttccatgcttcagatctacaggtcattaattatttattttcatcctgaaagcattttttttctatctatacaatgcccaagcctctcaaggaattttaagcaataaaggtaaaaaggttttctgtttttgataaataatattgagtttaaaataactggttgaagaaaggcattgggaatgcttccgtgatgtactgtgagcatggatctgctggtcatgcattatttagtatattctatatggggaaatacactttgcatttgggttttgaaagaggagttttgaaaatggtgttttgcatctgaattctgctttttcactagactgcatttgcaacgatgcatgtctgcaagaccccatggacaactttcatctgatgcacgcactcattcttgctttgacactccaagccaagtcacatttgtttccaccaagtcagacaacttcgatggctctctgcatctcactatatctctgtcctgctgatgccaccaaatgaccagagatggtccagacaatttacaagaaaggacgtgggcaagcctcatgcaaagtaagaaatagctagcttgtctttggtatttagcaatgtttaaattgatttgctctttcctcacttcactcctggctagctcctcgggatttagagtgctgatgcccaagtattgaattgtaattgttccggatctgagctgccatccctgagctccctacctccagtgtacattttttttttccagaattacatctccctccttttcctcttttattttttgcattgtaatgcttctatcaggcaaacccgtaacaaattaagatgcctgaaacagttaacgtaaaaaaagattgtttatttttcaaattgaaataaaagcatgtagcataaacattgatttaatttttagtgtaatttcaggctgttttctttacaacttgaatatgtcttcctcttccaaggtttggtttcaaggccatctccctcataccacctgctgccatgcaccccgtcctcatgccccactctttcggaaaggattctttcttatttagaggtatcacaactttttttcttagcttctattatgcattttattctgccttggagagtgagttgctgacatgcccttattgatataagctacatgatggcagcagtgaggtgtcacattaccttatcattttcagtagaaacaatgattcttccatggccaggttttaaaacctcttgccatagaagtcattgtttttactgaaacattctgttttaaaaccagctggatgtagtggctcacgcctataatcccaacatttttggaggcggaggcgggaggatcgcttgagtccaggagtttgacgccaccctgggcaacatagggtgacccaattgctacaaaaaaaaaaaaaaaaaaaaaaaaaattaacaattagccaggcttggtggcgcatgtctgtggtcccagctacttgagaggctgatgtgagaggattgcttgagaccaggagatagaggctacagtgggctgtgatcgtgccactctgcactctggcctgggtgacagagcaagaccctgtctcaatcaatcaatacagtttcctctctccccaaccacagtgctaacgtttgctccctctaccccaaggtgaaaggctggaaggctggtttaagattttcatccccagatacatagatctgaatttaaaaatacattggtgttttgaattatttgtgtggacattgacttttttaaaatgcggtttttaaatttgcagtttaataaaactgttaagttttatccatctggtggaatataatacttaaagcagaaaaaaatgtgtgctcataacttatgtttatctaaaatttgtatttgaggccactatgtaaaataaatagactgaaaaataagagcgtctctgcaaaaacaagtatttgtggtcttttcagcagcttgaatagttagatttctcttagtaagttgaatgatttaccctgttttctttttttggctaaataaatcatatttgtctatttttaacttcttttaagtttatgcagaaactctaaagttgcggaggaaaagcactgtattaacaaggcctattttcccagaatgaagggaaacttttgcttgtacaaggttaatttgcaaagcacaatttataacactatagagacgtctctcttgaaaccaagggccctatcatttctttttcatttgacatctgcagagtaagagtaaatatttcttaatttagaggaaggtaaggctatttttcaagtgaatccactaaattaatccactggagtaggcgttatttccttcatcacccgtctgccttaaatatagtacctgcacattcaaggcaaatgcaaaaatagcttcagatttaaataggtgatattgtctcacatataaaagatgagtcttgtctgtgatataaaagtagctgtttaatacttttagcaattttcagtggctttattttttcatatagttcctgtatttggaatgtaattaatggaaaggtttagctttgtccttgaaaaggtttccatttttctagcaggcttgagtcactcactaataataaacatgctgtatttttagctacatatccatctattttccatctaattcatttatttatttacagcttgtcctgtccctaagcttctaatgtggtagcacattagaaaatgttatccttattgcgtattcatctcaatttgaagatatcagaactccgtcaagacaaggctgggtacggtggctcatgcttattatcctagcacattgggaggccaaggcaggtggatcacttgaggtcaggagtttgggaccagcctggccaacatggcgaaaccccatctctattaaaaatacaaaaattagcctggtgtggtggcacatgcctgtaatcccagctacttgggaggctgaggctcgagaatcacttgaacccgggaggcagaggttgcggtgagccgagatagcaccactgcactccagcctaagtgacagagtgagattctgactcaaaataaataaataaataaataaataaatagtcaagaaatggttcaggttagaaatctgattctggtaatgtatttaagaaaatatccagtatccaaaatatttcaactgcatttacatattattattatatataccaacatgtccacacacaacatacatttacactggtctccagcttaaattgactcactcaggtacactcccctggcctgtttaatagagggggtcatgtctcttgttgtaccttattgtagacaaaattataagctcatacttgaggtctcttctttgtttctaacatataggaccgagagttgaaacataatacataaaaatggaacagtgatagtcagatttccaaatgaggaaattgtcttcttaggaatagaaaccagatgggaactcaacacagtagtggccaggaactgctggactctaggcccaagagccaggagacacccggagtgtaattcctgggaaattatgaaaggtgccccaggagtctgggagacagagccctttctttccagaaataagagagtttgaagacagctactgaccattactcagagctggcatttctatgaaattgatatcctagggaggagaaagggagctgacaaaacgtcaccaccaagaaccaactgagcaggctacagattcagtgaatggactcatgactatgccactcacgtctctgggtgggagctccaaccactgaggataagaccatagagaagggtaaggggataaggaaatagacacatgaagacagatgtgtgtgcaaagaagaaagagagacagagacagagtgagagagacgcatcttactcacctgaagatccaaatcccaaaacacatgcaaaaagaatcaagaagtggaaaatgcagtcttccaaattaaccacaagtttagattttaaaatagacattaagtgaaattctttagaatggggcaagcattctctagaggagcagttgccttcagcacaggacctataatgcctccagggaacggtacctctaatgcctctggagaccacaagggagaaacaaaggaaggcacatgcaagaaaaaacagcaatcatgaaaagagcaaaaaaatcatgaaacagagacaggcaggcaccagataaaagcaagtgggtatagaaattgcaaaatcacaactacagaaacaaaaaagatacagtaaataatatggtttggctgtgtgtccgcacccaaatctcaccttgaattgtaataatcccaacgtgttgtgggaggaacctggtgggaggtaattgaatcatgcgggatgggtttttcccatgctgttctcatggtagtgaataagtctcatgagatctgatggctttgtaaatggcagttcccctgcgcacactctcttgcctgccaccatgtaagacatccctttgctcttcatcttctgccatgattgtgaggccttcccagccatgtggaactgtgagtccattaaacctctttcttttataaattactcagtctcggctatgtctttattagcagcatgagaacagactaatatagtaatggaaataaaatataatactgtaaagtgtagactctacaatcaaagaggacactgaaacatagtacagaggatgcacaaagaaataaaaaataatatgaatacgtaaagagctgttaggagatatgtttatggacatgggttagtaaaaggagatgagagtaaaccacggcaacaatgattgggtagataaaggatggaaatattcctaaattaaagaaacatatgagctctcacattgaaatacatcacttgagtaccaaataaaatgatcagtaaatccacaggttgatgtaaaactaaagaatattgagaatgaagataaagttaagtaccttcccaagatattaataaaaagcagattgcatagaaaaactgttagtctgttaggagattcacataaacctcaggagaagtgaaagcgtcttggagaagtagcctaagtattgaaaaataatcgtcaattgaaaatccaatatccaggtagcctcagatcaagatgaagctatggaaaccactttcagatatacaaagactaggaatttaccacccatatatccttaatgaacaaattaacaaggacagttcttcagcaagaataaaggggaaacaggacagttcttcagaggaataaagggaaacaattgggcagaaaataatggggatttcagatactgttaaacattgataaatttcgtgagccatccactaagaccaaatgataaagattgcaattattatttcaggtaaacccaattctagaaggaggatggttatgggatgtggttttcaaatatcataaacatgctaaattttaaataactaaaacttatactttattgaaaacgtaagtgtattgaaattgtaaacatacaatattctgaatttatagttccctctgcctaaaatgcttttaacagcagatttgtatgtcaactctgtagtccatagctgtgaaaatttggcaaaagcacccagattctgttgtgtctgtaaaaactgacttcctctaacgtctagggctgtgctacttaaagtaaatgtggatataaatcccccaggaatccagttaaaagcaaaagcacccagattctgttgtgtctgtaaaaactgacttcctctaacgtctagagctgtgctagttaaactaaatgtgggtataaatcccccaggaagccagttaaatgcagattctggttcagtagggctgtagcagggcctgagagtatgcatttctaacaagcccccaggtggtgcaggtctaaagggtgcatattgactggggagatgcatgaataacaccacttctctccagctatttctaaaataaggaaactttccttcagcatttaccttaagtgtttagacaatgcattaagtacaacaaaaactatcatgaggaaccagatgtcacctacgacctataccacacttttccattttcatctctaataaggcggccttataacctcctctaggtcaaaagcaggagatggcaatctttttttctgcaaaggacaagatagtaaatattttcagctttgaggccagatggtctctatcaccactattccactctgccttcattacattgtagcaggaaggcagctatagacattatgtaaatagagggatgtgtgtggctttgttccaataaaacttcttctgcaaaaacaggtggcagagaagatgtatttcatgggccctagcttgcagacccctggacgataggttaacccaagtcactagtcccactagtccttctgagtaattttgagcagaaaaatcctcaaatattccttgatacttgacattttctatgcatctcagtaattaatcaagtgctatttaacattattctgttgttttgttttgttttgttttgttttgagatggagtctcgctctgtcacccaggctggagtgcagtggtgctatctcggctcactgcaacctccacctcctgggttcagtcaattctcctgcctcagcctcctgagtagctggaactacaggaacgtgccaccatgcccggctagtttttgtatttttagtagagatggagtttcaccatgttgcccaggctggtctagaactcctgacttcaggtgatccacccgcctcggcctcccagagtgctgggattccaggcatgagccactgtgcctggcctaacattattcttaaaagaacctaccactgaagtcctcagatcttgtgtatgaacacactcatggtgatctgttgcagctgggtaactggaagactttaaacaggggatcttggtttttccacgttcctccttgattgattgatatctgtctctgggcagcctaagtcacctgacctttcatgtaagacacaaccaaattcaatcccaggaaggttaagcctgttacccaaggacataaatcttgttcacaacagggttgaggctggattccagctttctgatttccttgtccaattattttcttaccatgcaaacagtagtctctgtttcctgttgaatatgtctacttccagcccttttggaagttcaccctctcccttaatgttttatggtacttgtctgtgtaccaatgtgtttttgcctttttctacatggcttttgctcaacataagaagttgcaggaaaaatgtaaatggcattaaatattcaatactctttttcccttaaagagaagttgtctacataaacagaattagagtgtgatttcctacaataatagtcttcctttactaggaaggaaatctaatgggccttttctccagctcttactgctgttttcagacaagtatacagctagcagctatccttgataatgcaggcatgacaaagggaaggacaaagaaagcccttctttttgtattggatttaaaaggtcttcactgatatagatatttttgttttataacccattctgtgatgtctgacagcaatttctttctgtgacctccccttccagtggcaggcatggttatctgtttcccagtggcagtgcatggagtgtctgtccgcagagcatctgtgtggcgatcaggagcggcggttcaggccacttcatcttttgcaccatgcctctcacccggatgcatcttattcttttatgtttccctgtacacttgctcttgaactgaatattacttcttataaccaagtactctattgttgaggttaaaatgcttagagatatctgattctaatttttcacagaaaatgccacctcacacattcagttaataaataaaacaactgggccatagagaggctattgaggaagagtggaaagggatgaagtgggtttgagtctccgatcccgaagctcaaaaacagtgatcgcttttttattatttttccagcataccctcttttcagacatacaaatatgttcactgaatgtgcgtagtcacaagagacaaggatgatatgcattttaaaatatgtatattacaagggtctttcttagcaaaattcatgcataccctgcattttgagagctgcttctagctgttagcctggctgaataatacacaaatttataattcatgatacgcaagagggaaaatgagcaaaataatatcataggatatgaaccttgccttccaaagatgcaaatccacccatgctctttttatgacttggaaggagtcacttagtcaaaataacttagagtggagaatgcccaaatgctttggcaccagcaaagctgtgcgaggttgccagaatatgttccaaatgcatagagatgggagttagcattaaaagccattagctcatgcccaaaatctggcacgtccattcactgacagtcctctgatattacctttcagtctggattcccttaaacttggagttgaagagatgctactgaatcttgggtactcttatagaatgacatgtataattattaatccagtgacctcccttagtccttcaaataaatgttattgtcacatgctactttatttgaagcaccatacgtattaggtggtgcaacagtaattgcagtttttgccattgaaagtaatggcaaaacccataattacctttgcaccaacctagtagttaaaagaattcatcataaaacagaaaacatactaaccagtgttttacttattcacagttatataaagaatggcactgcctaaaaatgtttctattttgctttgaaattcatagcaatgcccatttctagaagaaacaaagggtgcctattctagcagctcatggtcctaacatgagattagaagtttattcttactcctactagcccagtggtatacaccactctatacagcaatgcacacctgtagcacagcatgttacgatcctaaaagagcaaagaaaatgggagctagaccatacctcagaccctctcatccctttcctttcccgcttactgaggccagtgacatttggaagaccagtgtgtaattttccacattggacagacctgattttattcttggtcaacattgacaattttctcctttctaaaatggatgtattggtatctagctcacagggaaggtgtggagattcacctgaggatacacataaacagcaaagcagaatgtctagcctttaaaaggtctttatgtaaccagaacttttttttctccttgtatctcccatgaaggcctggacattatcaagccttccctgacacacatgaacaaggtaggtcaatcccaccccaaactcaacataatctggaatcagtactttgttgcaaagcatatagctatggcactgactctgcattttatgcgcagaggagatcagagacataacatggttttgaaccataggatgtactttcttttcatggtacttcaaagtctcccactgctactagcaccaaagtctcaatttcatgaattgcccatatagatagacagtgatcagcctctcgcccccttcatcccaaaagcttttcttcagtggaaaatcttcctgcaagggaattgtacctgtagaatggggaagaaaaagcagaaagcatgaatctgtatagatatgagaagcaagggtggctccctgcttggatgaactaggtctctgtgcatgagggtcttcagtgttttcctgcactagaccgacaattgtctatctatatgggcaattcttgacattcagactttggtgctagtgtcagtgggagactttgaagtaccatgaaaagaaagtacatctggtttaaaacaatgttatgtctccaagctcctctgcgcataaaatgtagagtcagtgccatagctatatgctttgcaacacagtactgattccagattatcttgagtctgggaggggggcattgacttatcttgttcatgtgtgtcagggaaggcttgataatgtccatgccttcatgggagatacaaggagaacaaacagttctgattatataagatcttttaaaggctggtgcattagctgcttattttggttcaaaatcttacaaaaatatgagaggaatcaggtattactttgagcatttgaaacacctgtggcagaggaacttgaaaagaatgtgtcacttttcattgtctggttttctagccctttgtcacaaggtgattttattcttgtgcatctaatgaccaggagacatcatgatggtttcattagcacctgtggccccatatggtgtcttaagtgtgaccagtataagcgtgctaattttcttaaaggaagcaaaattaaactgtgtttcttgttagagatggaaaacaggtggtcagccttatcattctcgctaaaccttatggtttccagatttaaacaaccttgtgaggtctgttaaaggtggtgtaatgtggactctgtttagtcaacatgtaattcactatcctatttcctcttcagtgattaaagtgaaagtcaggctcttccaggagttttccagtggagcataaaagaaagagacagtggaagagaaattgtacttattgaaaggaatattagccagatgactctttgagtgactgcagatgactgttccctaagtctagctatttcttttcttgtaaactttttttttcccatttccattccctaagtcaggatccagaacgttttgtggttcttctatgtgtttgattttcaaactttgactccatcaggatgaaatttcctaatctatgcaggaggaatagctttattcaacaaacatccatggtcctttctgactgtcaggtgttatacaacaacaaggtttgattgcctgttgcatgataacaggcaccaatgcaccaatgcatcaaaacagcaggagttgcagtagagaaagagtttaatcatcatagggcaactaaatgaggagatgggagagaacctcaaacccacctttctgaggagttttggactggagtttttaagggaattttggtgggtagggggctgaggagctgggggttgtttatagggtgtgattagggatgaaaccataaagatatagaaactgcattttttcattgagtcagttccttggaggggatcttaagacagactggcatcactggacccattggaatgcagaatctggaaaatatctccaatggagaacttgaagtttcttaatgttaagatgttatctatagaaacaattagggaaagttaggaccttgtgacaggagccacgtgactttttgacagtaagcagctataaggaagtgggctgttgggcaagctggttaatgcttagctttgcttctgctcaaagcttaggcttttacttaaaaactaccaattcagttgcattaatttaatggtgatggcttcacaggcactgtattaagtgctcaccctgcattaattctttccatctgtatgacaaccatgtgatgtaggtgctcataatgtctccatctacagatgaagaagtggaggtacagggaaggtaagtaatttttcagatatacagttgggatggtcaaagccaagtctggactagactctacatgctttctccatccctatatctgcataaacatgttcagacaatgaaacaaaacaatgcttgtaaagtatcccacccaatgacaggtgcaagaaggcaaccacaaaatggaaattatctttttccctgaaatagtcttattcctgggactcagggttcttgcctttagtctgtgtcccctgtgattcattcctttcactatataagttttgtgctctttatactcacttagataatcacattactattacctggagtgaagtgcaaagccgtgttcttcagccaggaggctccatctttcctcaggcaagccttattcttaatcattttctacctcaaaacctgtaagctgcttgcagaggttgctcaatgcctcccagagcctgtattttccttacatatggcaagcattcaatcaataattgctgtttgatcaatatgccaaatgtaactcttcatgtggataagtttacagagtcttttccattgagtcttttccattctttcctgttataaaatcaactatgaacagttgatgaacagacttggctttgaccatcccatctgtatatctgaaaaatacttaacttccctgtacttctattccttcatctatagatggagatattatgagtacctacatcacatggttgtcatacagatggaaagaattcatgcagtgtgagcacttaaaacagtgcctgtgaagccatcatcatgaaattaatgcaactgaattggttagtttttaagcaaaagcctaagctttgagcagaagcaaagctaagcattaaccagcttgtccaacagcccacttccttatagctacttcctgtctaaaagtcatgtggcccctgtcacgaggtcctaactttcgttggaaaatagtttattttataacaggaaagaatgccatagagacagatcacaggaaggaaaagagacaaaatcttcacaaatgggagtggagacttgcacttgaagaaaaatgttgcctttctcagaatttgttaggtgagatttcagtctctaacttagtgcctcactgtctgtgttcctcacagcatgggttaatctggtatgagatacaaacctatttcaaggcagggacaaatataggccttcaatttttttttttctaatttggtatgggttatctatagaagtgtaaatggttcacagcaagagattgcttttcagagaagtacatgtaagatacagaaatctctagatgtgtctgtaccttaactttgaaaaagagaaacttttaaaaggtaagagctgtttttcctaaagagtcattttagaaaatgttctagatcttcctgtacataataaggcttctaagcatttggggttattttaaaaattggattttaaatattttaaacatttggatttcagaatattcagatttattttattctcccagtattgcaaatacaaaggcaaccatgcagtataagaagagaacaggataaaatgaacatggacatgactttaaaaagaattcaaagttcaatgaccaaatttaaattcgcattggaatttgtaaagaatgtaactgacactaaaaattttctggcatgtaaaacatggggcacattcccagaatgcagacaaataggacaaatagaataaatttaaaaagaaattaaaaatacaaatgacaaacaaaagaatcaacttataattagtgttcttgaagatgattcacaagcaaatggagcagaaataatattcaaggttgtaacaaaagaaaacttttctacagaaaaaaaaagcagagttgcagattaattgggttcactttggtttgaggaaaacttaataaaaatagaaccaaaccaaaatgtgttgtatcatcatagtttaaataaaagtgaaatatcaactataatcaccctggcaaacaaagtatgtggcatgggatggaagtattcctgggctgggtccaacttctctgtaataccaaacaatgaaagatcaagtaatatctacagagtgttgacgggttaggattcagggcccaagaattcaaccccaaaaaagattttcctcaagtgtaatggcaagagaaagagacactaaggtatgctatggtttacgatatataccacacaaatagcttttctgaaaaaaattacttggatatatattccagtttaccaacatgtagattaaaataatgaccctgcttaaaatcccctgattgaattatttatttaatcaacttactagacaattattgaaaacttgattgtaatggaaagaatgagctcaacataattattgaaaaggaataatactaaaaattatagctattttagtaaccaccattttgttatagatgccattcactgtattttgaaattcacatcatctatttaagtctcatgagttaagccttatagcccgaactcatagagaaaaacagagttggatgaagtcatatacccaagatgatgtgaaaattttctgagggatgcaacagaggcatcctatttccaatatcatggctcatccgcagatttggccaaaatccagaccagcagtttgcaaatgtttctatgctttagaatcagctgaggaactgcaaagacagtcatgcctgtgtggccccccacctctgagattctgaattgattttctggggtgccacctggtgtttggagttttaaacaaaaccttggatgattctaaggtgcatacaaagttaagaaccatgaatttaaacaataatatccgatctcttctacaaagacttggaaatggtgtgagaggagcagaaagaagtttaaatctgtcactactcatagggaataatcaacggtaattgctgggtttttcgttttgacaattagatcaagattgttgcacagctcttaatacactggtaggaaatatggaagagtttcgaggggacattgcaatgaaatgggattgagctagggcagtggtgcacacctggggcaattgtatccccagtagacatttggtaatatttggagacatttttggctgtcatcactgggaagcatggagattgactattggcatctcctgagatactgataaaaatttgggaaaaaggcatggattcctccaggtagagagtgtatgataagattaatgacatatttcctaaacatttatttttccctaaatcaaaatgactgtctatccatgtgtgcgtgcatgtatgtgtacatgtatgcatgcatacatattcattttcactatatttctattcttcatttaattttattcctttcaagtttgaccaaaagaccttacaaccagtctgttggtattttgaaagaaaatttatatttgtccccattttctttataatctttcaactttgaccacaaacctatattgttttcttcaactgatacattttgggtagcatcaaaattatattcagtatcgtgctttggagaggaaaaacgtgctgttcccattttcaagcatgccgcaatcctgaatctactccttacaaaatttctgtgtcagcttggatacatgatgtttttttctctatgtgtttgggttataatacataactaattctgtttaattctgtttttttctctacgtgtttgggttataatacataactcatgtcaccattatgagacttaaaaaagataacttatgcaaatttcaaaatatagtgtaaaatagagacagtggcatataacaaaatcgtaagtacataacaaaacagtggtattgcactatgatatcttcagtaaatacatataagtgttgtacccagtgtcacgtctcagttgctgtcatatcaccaacattatttttgctttctcctcttagttgtatcttacgagagccacatacgatcatttaagtcagagatgaaaattcaaatgcctgcaggagacaggcagctatcacatgggcatgattcaggctgagtgtgaacagcggggaactagggatgtctgcaattggagagtgcttgcccactgcaagaaggaggagaaggagggcggggagggggaagaggaggaaaaggaggagaagaagaagaaggaggaggagaaaaggaagggagggagggaagaggagggggagggagggaagaggaggaggggagggaagaggagagaaggagtaggagggagggaagaggaggaaggggagggaggaaagaggaagagtgaggaggagagggagaagggaaaagagaaggaaaaggagaaggagaaaaagaaggaaaaggagaaggggaaagaaggaaaggagaaggggaaggagtagggggagaaggaagaggaagaggatgaggaggaggagaagaaaaccaaagaggaggaggaagaagagaaggtggaggagacagtaaacatgaggtctaggctgaccaaacaaagcgcttctgcaggttagcatagccccttgtgcctctcctgcccttggtcctagccatgcattgaagagaaaggggtagaatccgaatctgtgagtctctaaaagaaatttagacacatcagattattttgagtaaaatatatagaaaataaatattgctgtattgagtgcttttcagagcatatatgtgacgcatcttattttcctctattaaagaccatgtgcaataaagggtaatgggtggaagtgaggaaagacaaacccatcctgccccacctagaggacaagttactggtaacttgctgttttaaggaaacgacacagggagatcacaacgacctcaaaaggacttttctgcaaacaaatgtaagttatgttgcattcataagtaactgaagccaaaaccctactcaaaagggttatacaaaaaaggataattattggctcataccaactcagtggtcgaccattagccttgtgtaggaactgtattctttaccaagaattgtaagtattcaagaattgttggtgacaaccgtgcaagttttccctgttgtaaaattgtaacataatttattccaatgaaagaaacccatagacattatccttaacattgacagaccaactgcctagagaaattcttttctgaaactgtttcctaaaacaattagttattttacacacaccagcaataggactaagagaaaatagtatcagagatctttcagagaccgtatcaacagaaaaaaatgtaagttgaaagtacaaattagttttcagaataaatgttcagaataaatcattagccacctgctacttttaattagcaaagctttaaaagctcactcattgacttagcataatgtcctccaggttcatccatattgtcacaagtggcaggattttcgtagcagaataatattccattgggtgtatagattacattttttaaatccctttatccattgttggacacttgggctgtttttacattgtggctattatgaataatactgctatgaagatgggactgcagatagctcttcaagatcctggtttcagttattttagatatatactcagaagtgggattcctagatcatatgttagttccatttttgattttttgaggaacctccatatggttttccataatggccataccatcttacattcccaccaacagtgcacaagggtttcagttttttcatatcctcaccaacacttgctatcattttttttataatagccaacctaacaagtgtgaggtgatatctctttatagtttgatttgcatttgtctaaggattagtgatgtggagcatattttaatgtgcctgttggccatttgtatatctgctttggaagtgaaataagcctgtcacagaaggacaaataattcatgattccacttagatgaggcatctaaaatagtgacactgatggaagctactcaggggttgctaggagctggagtgggaaacatgttcaatgggtataaagtttcagttatgctagataataaggtctagagatctgcacatcaatgatgcctatagttaacaatgtggtattctacacttcaaaattcgtttagaggggagatctcatgttaagtgctcttaccacaaaattaatcaatctgtcaatcaacagaaggaaactttggaacatgttcaatttgtctatgtattagtccgttttcatgctgctgaaaaagacatacctgagactgggtaatttataaagaaaaagaggtttaatggactcagttccacatggctggagaggcctcataatcacgttggaaggtgaaaggcatgtcttacatggtggcatgcaagtgagaatgagaaccaagggaaaggggtttccctttataaaaccatcagactcatgagacttattcactaccacgagaacagtatggggaaacctcccccatgattcaattatctctcaccaggtccctcccacaacacgtgggaattatgggagctacaattcaagatgagatttgggtggggacacagccaaaccatatcagtttattaccttgattgtggtgactgtatcacagttatttgcaaatgtccaaactcatcagattatacagattaaatacgtgaaattatgtgtatatcaattatacttcaataaagctgttaaaaaataaaaactaaaataaaatagaaaataagttaaagtccacccactgaaaaaattatagtataaaacatagaattatgccaggcatggtggctcatgcctgtaatcccagcacttagggaggccaaggtgggaggatcacttgaggccaggagtccgggggcagcctgaccaacgtggcgaaaccacatctctactaaaaatacaaaaattagccaggtgtggtgccatgtgcctgtagttctagctactcaggaggctgaggcataagaatcccttgaacccaggaggcggaggtcgcagtgagccgagatcatgccattgcactcgtgcctgagcaacagagtgagactctgtctccaaaaaaaaaaaaaaaaagtgaaatcaggaaaaatttatataaaatctaaggcaaaaaaagatgcaaataatttatttaaaaattgatagtttgatttagcttttatttctgaaaattataatacgatatatccagagcaaatcgagaaaagcactttacacagtaaagcttggatatgttcaaagtcacaactagatagcaaaaaaatattccatttaaaaactgttaatctgtattaaaggaatcctgccaaaaaagaactgggaatctttcatgaatttataggcactgtttgccatcctgatccaatttttctcttgttgaaactgcttcattaatttaatgtgcaagaaataaatatttgatgtgcaattagttggagattattatggccataatggaacctttccaaataaacagctgctccagcactttaaatgcatgaaaagcaagacagaaaatggaaaatataatgaaacactagctctacaggaaaaaaagttaaaatattcaattagtgagtaaggtggctgctcatttagaagtttggtggtggtttatcaaagcataacagcataagagctcctaaactttagccaaatatccatccacctaaattttcatggaaacattcacctgcagatgtaatacattcttctctgacaagaagagagtgttaggagaatagacattggccaattctaccaatttcttcacgtgttttattatatatacataaatgtatatcaatgtatatttgttgagttttgattattctacattggcatttatatatgcactataaatacctatttgtatatccacatatgaattgtaatgattccactttgagagggaataatctgccttaaaagtttcacactgactgggctattttaagtctgagtgagcttctgaggtttcatagcatgtatgcagaccccgtgaaggaactgacactattaagttagttaaactccttgggagttttacaaaatgttatcttcctttcaaaatggactataagatttggagtcagttgtctctcttatctactgcactggaaagcacttgagggtagataccatggctaatatctcagtatctccaaaccctgatatagttcctgacacagagtagctcaaaagtattcattgaaagaatgcctaaggcaatttgcaatacagatggggaagagatagacatcaaagggtgagtattatgagctacacacacacacacacacacacacacacacaaaaagtttactaaaatagatcaatgtctcctattgagatgggagcaaaaggatgcaatcccattggcattctgttccactgcagacataatagcaaaagggcaaggttgttgctggaactggcagtatttggcttgtaattacagatttgaatatcaaaaataatcactgggaactgcttacaatgaccaatgttttggtatacttttctagaaaactgacttggggaaaatttattacttattggggctctattctattttgagattcgattctgcaattaattacattttactcctccgctttgctctaaaaaactcattggtccaagggaattcaatttttaaaaaaaaattattttctctgctccctgctgcttccatgagtgaaacacacgcacatatgcacacacatacatgcatacacatgctcacatgcgtactatggaggagcaaatgaaagaataaaggcattcatgtaacaccattttgccccagattcgatccattcgaatgtgatagatggacacgaactgtcttgctatacatggaggtgtaatgtctttgatggccctcccatgagtaggtagggttaatgcttccttccctggattctgggtgtacctacaatgtgtctaagaaggaggtgatgctgaaagtctcccaacacgaggtactcaaagatcatacggcttcttcccagtgtttgtggcattctcccctagggatgcaggcaccatgctttggagaagccaagcagccatatagataggtcccacatcaagtcccctgccagcagcctcagctgaagtctcagggacaggcaacaaaatccccagacatgtgagtcgtcagactcgcgatgatggagcccccagctatccttccagcaagccagctgtcgcatggaacagagacaagctgtgcccacagagacctgcccaaattgcagatttgtagggaaaaaaaaaagactgctgttgatttcagccactaagtatcatttgttatgaagcaaaacacaactaaaacacttgtgtgccagaatctgaaaccatttatttgataaacttatttttagcttataacataccaaagctattcaaatgtgtggcttcattgctacccatatcctgccgtccccacattacacagtaaggaggggatatttattaagaaatatcttcttgtgaagccagagcctaagtcactgctgctattcaggagcttacattataatgggagaaaatggggacaaatacataaattagtaccataaaaatagtacacaggagtactctgcaagttattcattcaatgcatgtgtaaggcatgctactgagtcccaggaacattgctcttcatgctataaatgcagcagggatgaaagtagacaaggatcctgctgtcagaaattctatatccctgtgcacatcaataaccagtagacaagcaaacacacaagaccctttcagatcaagaaaagtgcagaacacagccagggcacagagttgagaggaattgtgaccatagacagtgagggaaaccaggatctgtcccacaaaagatgcctctttaacatagaaattatttatgagccaaaagtaattagaaagcataaaatgaaggaaatgctggccctgtcctcctgcttttctgcctaaaggcaaaatatagattctcctttactggagatgactctaaactcttatcagcccagagatggcatcagagagatctgcaaacaaaacttactccattaagtttcttacaatatatttaccttcccaccattgctgtcccttggtagctgaaaccactttcctttgtcttaccatttctctacacatgcattgttcttggtggaatatatcctgtaagccagatttctaatccactgccttgagctacctttcactgagatttctcctgtatgatgtgaacagcacaggcgaatcagcttcctttttccttctgttgacttgccttttgttacaggagttcatcccaactgagcttatggaggatgagaaaaagtatatttcttccctgataatagactatggccgaatttttctttaataagatggcatttaagctgagatcttatggagaaaggtggttggccatggcaatacatgaggagagaatggggaaagagcaaatgcaaagacatttgagggacttggagaaacagaaagtcagaacgtgaccaacaagggggaagtaatgagagggagatcttttggagaaatatcccaggtgagtctttgtgggacacatgtgtgccagagtctgaaaccatttattcagatgtagtaaaagggccttcaattttattaccctgattgctacgggaagctactggcaggtgtcaagcagaagagtctagtaatcattcatgtggattgagtataaatcactttgactgctgagtggtgcttgggtgagaatcggaacagggagacccagttagaacactgcagttgatcttcattatctgcagattctgtatttgtaaatccatctagttgctacgtttatttgtaacccccaagtgaatactccctgtgcttttgtggacatgtgcagagtggtgaaatattctagtacattcccagctgaggttgagtaaggagacactctgccttcttgtttcagttctcatactgtaaataactattcttttcgtggtctatctagggctatattgtttgtatttttgtgctttttgttggtgcttttgctgtttacaatggcccaaaaatgcagtgctgaagtgctgcctagtgttcccaaacacaaggcagttgtgatgtgcctgccttacagagaaaatacatgtcttagatatgcttcatttatgcatgcatgacagtgcagttgggtgtcagttcaatgttagtgaatcaacaatatatatccagtaaagtatgtttgtacgaaaacacacccaaaacaaagttatatattggttggttgatgaaaatgaaactggagctcacgggaacctaaccctgaattttccaagaagaaatggttccatattcagtgtttgtgatgacctcttagagcacaactacctccaataagcagaattaaccgtatcccagtagtccaggtggaagacaaaggttgtagaattggtgagaagtggttgagcttggtcaactggcagggtttgggagtgatctggatgttggacaggagaaatggagaggcactgccatgtgtggatgctacgtggacaggcagggaagggttgcatcaataaaaaaggaacccacatgaagagggcagcatttgaactgttccttgaaaggatgaactcgtgcatttcaaatttatttatcacatatacacatgtatttaagtggaagttatatactcacacagcacgggaacataaagcttagaaaatttatgagcaaagtagagttatttcttgtagtatttttaaaggacatgtttgttttgtgtgtgtgtattgggaactcaatccttatctcactacaaatacattaacacaaaataaattcattggcctatacacaaaagctaacacagtaacatttctggaataaatcataagagaaaaatcagcaaccatagggataagacataaaactataaactataaaagtaaagaattgataaactagacttcatccatgttaaaacttttctctggaatacacaaatacacaaaaaaatgtcagacacaggatggaagaaaacattagcaatctaatctaataatgtaatggaattcaatatatataaagaactctgataactcaacaatacagatcaaaaaagccaattaaagatagcaaaagacacattacgtaagaagaaatgtaaatggccaataatgacacggaatgttgctcaacatcattagttatcagggaaatgtcaattatatcacaatgcaactccactctgtacccactagtctggtttaagtggaaaattctgacaatttcaagtgttgtcaaaaatatgaatgcttactcaccacttgtgggagtctaacttgggaaaagtcctggaaatttgtcataaagttaagcatagtgaccatataactcagctatttctcctttctttctttcttctttctttctttctttctttctttctttctttctttctttctttctttctttctcttcttttctttctctctctcttctttccttctttctttccctccctccttccttcctcaaatttattcaatattcattgaacctttctgatttttaaaagactgctctaaagtcgataaatactatataacttacattcgattgcagtgaggggcagagaattatcaagcaaaattatatttcaaaagattatttctttaaatggggttaaactctatgaagaaaaagttatgtatttcagattgaaagagagtaaaaggagaatgtgggcaactttgtataaggtgattagggaagcaaacctggaataatgttatttacagaaattaatgcaattaatggacatattctatactgatggcatatttctatataatctctgcctctaaatatgtaggcataaatcatttttctttaaccaatatataggtctcttttttaaccaaaagaattgtttaatagagaaagaagacttcgttgaatccaaacggtgagagacatcaattttaaaccaaaagtacttctgggtgttggcagatatcctccatagacagctacctctctgtggttttcaagatggtgcccttaggatataggcatcagcatcacctggcaaccttatttaaagggaagcttccagtgactacttctggcaatcttattattaacaagcacttgggctgattatttggtatcttaaagtttgaataccattggctgtcagttgcaactttaaaagtgctgacataagattgaggagggtatatttgattctgagtacaccaggcaggatcttatctttgtgatactgagccatgggggacttcttaactttatgcaggaacttcttaggctgcctggactaccaagctctagtctttcctggagaacactgagatgtgagtattagatcttggggccaggagttctggccaagttggagcactgaggatgcaagaaaaatctcttaaaatctcacagactcagtttgcaccttggagaagaagatcaaagtggtagtatatatatgcacaaccctattgcccctctccaatgaggctttgaagatcatatgcatactaaacctaatgttgatattcacagttttcatgcaagaaaagaatagaaagtgattgagtttctactgtgtattaacacctttaaaaatattatctcaattaaaattgctgaaatcttctccatgacagtttagggacagtattgctttctacatcctataggaagaaataattggttgaagcaggagaatagaaatgcaaatccaaaccttgcttttgccacaagttcaggttaactctagaagcattatttgattattttattctaaattcctttctttttaaattaagagtatttcatgcgctccttgtatgcgtcaatcaagaaagactttaatttggctttttttaatgatccaccacccttccacgtgctgtctaataacatgttctaatattatgatagcattgctgagttccaaaaatgcatttcataattgagatggtggcttatcaatggcagcaggcttaaaatgaacaagaatccaaatacttgtttcaagagtttattttttattcctgattatctaaaaactgctaggcaattttttacctaatcatatctcaagtagtgttcgatgaaaacattttttttaacccatggaaacataagcaatggaaaaaaagtgcatgtgaataaacagctttattttggaaatctagggaagaaaatatagcacaccatttcccaatttgttttcctactcaagacttgtgttgaaaacaccaagccaaagataatccatggttcttaatcgtatactgttagatgtgcatgaccaagcgttgtcagatgtgcatgaccaggcattgttacagctccccctattgacctatctcctgtcttcttctcattagaacatttgttctttgccccagagtaaggcatctggccatattttcattaattcattctaatacctattttgaggattaacatatttaatatgcttatattgaatatttgtcaatttgtataaaattatatttaaatatatgtgacatagggccaggcatggtggctcacacctgtaatcccagcattctgggaggccaaggtgggcagatcgcttgagtcgaggagttcgagaccagcctgggcaacatggcaaaatcctcatctctagcaaatatgcaaaatttagcctggcgtggtagcatgtgcctgtaatcccagcgactcgggaggctgaggcaggagaatcgcttgagcctgggaggcagaagttgcactgagccaagatcacaccaatgcgctccagactgggtgacagagccagcctctgtctcaaaaataaataaataatgtgacatagcattctgtatatagtacaaggttcagtggttcaaatgcttccatatgtaggtgtgggcgtatctgtgtttacatatgtacatgtatttatgtgtgcatgcaaacgtgtgtgtacatatataactaaaaatcatatctatagtacaaatatatatacatacatatgattttttcagtagtatgtgtatacacatatatgcggtacatacaatcatacatatagtacaaatatatatctgtgtgtgtgtgatttttttaaaagatttgtgttccaccaggaggctatttccaatatttgtatggactctaaaggattaaattaatttatactacagtccaccttctcttttaacatttaaaactagaatttttatggctagatggtgatatttcaatgagcaataccttctacataataagtcatttaaaaacttgccatttaaatcaataaaattttgcactcaatacttttgcactcaaaagtattttaaagttatctaatattttgaactttaattcacttatcaaacagaaaacatccacttgggaaagtctaatacacctttggttaactgcacaatgtttaaaatccaataaaacttaataaaataatattttaccaacaagagaattaattcctatgaactatttatctatttgtatagtctgaggctcatcataaatcaaataaaagcatagtacctcagagcagagaagtacacataatatgcttgtcctaacatgatttttattacttgcatttccctctggaggaatacagtgaatgaattaatgaagttggcttttattactgattcattgcatataaaatgaaaaagccgctttggatgttcaagaatttacatgcaaagtagactaggaattccaatgtcagtttatgggctatatatatgtactgcagaaggaacagggaaaacacaaaactgagggtgttttctggtggatgggactgccaggaggtcagtgtgccttggctgaaggaacacggggtggtttgtaaataaagcatacaaaccatcagcctaatatttttggtatggacatcaggatgtctgtgggcaaaccaagtcaattgctaaatgcaaagttgcagattgaaggctgctgtggacatgaggcttgagtccccaagggtgtcctagacattgggatattagtttggaccctgccagagttggttcaggggtcagggtaggactgcagctttttacatggttttaggtgaaaatgggggtcgatgttgcctttaaagcctgttcagcaaggagaccactttgccaggctctatttatgattgacaataaatgaattatctgtttcctttcccgtgcccacgacttcactttactattgtgacaactttcttagtgagagagagagcaatgctggatgaaagggcaatggattgttactgagaactttgttttgtgtgcagaggtgaagtgaacaggggagtagaggttataaagtgttattcgggttctatgtgaatacctctgggtttattggaacgtctgaatgcgatgcctttctctcctgctaaacagtaagtaaggactgggtctgctcctgcaacatggcacagtatctggcctgaaaaagtactcgattaatatttattaaacaaatgaatgaggttaagtgaatatatagaatgatggatggatggatggatggatggatggatagatggatggattaataaatggttcatagtgtgcaaaagagggaagaaggctgggcatggtggctcatgactgtaatcccagcactttgggaggctgaggtgggcaaattgcttgagcccaggagtttgagatgagcctgggccacatagggagaacccatctctccaaaaaaacttaaaaagttaatcaggcatggtgatgcacacctgtggtcccacatactcaggaggctgaggtggaaggatcacttgagcccaggagtccaaggctgcagtgagctatgatcgtgccactgaactctagccttggcaacagagcaatactctgtctcaaaaaaaaaaaaaaaatgaaagaaagaaagaaaaaagtaggggcgaggcataaaatgaaaaagaaatgctcattacatttttttgaagttattaaaacatacaaataaatcagagtagtcctttcaaagaaagattagattagacaaaacctctggtaccaggtcttatgcctggtgagactttggatctcctcctggacaagaactttctaccctgttataaacattcaaggcaatctcttaagtgctctaagtgattgagcatctatccctgtgatgcaacccgaagctaccaaaaccctcccagatttctacttagttctgcctcttccttctccttctccttctctttattctccttccgctccttcttctcactctctttcttctcttgttcagaatttatctacttctttaaaagtaggcaggagcaagcttggtcaaaataaaaatgttgtaaaaccttgatttcgttagttttgttgttaccccctgacaatgcagtaagctcagaactgctaagatttgatgatggaatttgaccaaaaattaccagaaaatcctgcatgttgtacaggaagggggccctgagacacttggaactttacaagagcatcagagaaacaggcaattgggcaacactgaggaaaggcagagaggtgagggagaagatgtaaaatgtcactgatgtaattttgcctagaaccacccacagcacatcgtaaaaactaattagatctctgaaaagagacatgcaagagtggataagtgagctccttaggtcaaagtgttaaggaggtccatagttactgaggtaagagaaagaagaaccatcagaatggaaggagtattcagaaacatgaaagatgattatgtgaaggcagtgtctaggcgaagaaaattaaaaattataaaggaggaacaatgcatcaaatgaaatacaagaagccaagaagtctcggaggcttaggatgcttgaaaggatcctaagaggagtttctccaaggggctgaaatggatattagaaaatatattagctaatatatgcaggagaagtttacagaggacattatcataattgaagggacaggagtggaagtaaacgtttccattacgtgtagttgcatgagtgtatctttagagatgacgatcagagaattctggaacaccctgtgatacaatatagtgtagtttttatgacctaaaatagcacattaggtagcttcttgattaatgtcattacagtggcctggagttaaggtgctcttcaattgtcatattcctctacaaacctacactggtgaattacatggaaatagctaaaggacccaggcaattgttggttgacggtgtgccttaaatatatcatgttaatatagtgcttgcagtttaaaatgtcttcccacatacatttgcccatttaatttcctcaatgtgaggcaggtgctaatctcattttatagtgagaaaattgagcgttagagaggctgaaagtgataccctaataaggggcaagagttgttcttttttgtcagctaggtcaacggccatttatgccattgaactcatatcaagtgctcttcttctttctctataactgtgggaagacaaaggtttatcccaaagtgtgtgctataaaatcagtcctgcaagtcatatttccacgcatatcaattttgccaatgtacacattgcaaaattacttttgttcttccattgttccatcgacaaaacactaacgatgagaaaaatatctaatccatgggtgctacgagaattaagtaaattaacatgtgtaaccttcctagaaaagtgcttggcaaaagtaagcagaaaatagatatttatcattataattgttggtgttgtattgttatgaatgaaacgaaaaacaaaagtatagtcatgcacagcataatggcattttgatcaatgatggaccacatataaaatggtagtcctataagattataagggagctgaaaatattctatcatctacaaatattgtagcacaacacattactttttctatgtttagatatgaaaataccattgtgtgataattgccttcagtattcagtacagtaccatgctgttcaggtttgtagcctaggagcaatagcctataccatatagcctaggtgagtgatcgactgtaccatctaggtttgtgcaagcacactctgtaatgtttgtacaatgacaaaattgcccagtctcacatttctcagaatgtatcctcatcattaatcagtgcatgactataaacattttttgggcggaaaccaatttttcacttgtgaaccatctccgatcagtaacaaagtgtcctgttagctcccatatgaaggagagcaatgcttgagtggcaagcaggaatgaaagcgcagttcacctacctgtcccgtgtgctctcaggctctcttccatcagcagcaaagccctcctcccacccacacacacagagtcatgcacgtactcacacaaattcactcacatgcatacacagacagggtcatacacacactcacacacaccttcactcacacataccaccatgtaccaagagtcatacctaccaccaccaaggacgccatcctcctggcaacatcgaaaagaaagaagagaggccttgcagctcgccagaactatttcttgatagccacacttgggcaatgcggtatttgatgtgtcttcatggaggcatcacctttgctgttgttatctcatccacatggccatagtcattgcttcacagaggactgggtaaaaaaaaaaaaaaaaacaacgcaaataaatgaccactcacaggttctgagtggtgagtgagtaaatgttggtgctggctcaggatggctaatgggaactgctagcaagttagctggggccagcctgaagggcctggggagtgtgctgctggccgcagtagccacttcagagaagcctctaatagcaatgccaggaagggacagataacactggagcaacttcagggcatcaactcccagatcctagcttggctgcctgtctattgtcctgtttcctgaaaacaccaaggaatggagtcattcattaactcagcaaacacttaaagattgcattctgggttctgagtggttttaggtgctaaaaagagaataataaacaaaaccacaaggctttttgtcttctggagctgatacttaaattgatgtgagacagatggtacataacacaaaaaaacagctgttatcggttaaaattaggaacaatgaagaaaatgaaagaagataatggaacagaagatgacattggatgagatgagcctctatgaagaaaaggagagagtaacaggccaacgggtaagttgggggcaggtacggcggcataagttggtggatgcaacaagtgagctgaaaattgagtggcgagaaggaacctaccatgaaaaataaatgtgaggagtatgtatttctggcagtgcaactaagaactggcaaggtgctgagataaaggctctagaaaggtgtggtgtgttcacggcataatgaacaggaggagagagagttgtaagaggaaaactcaaagagataaaagtgatgtgccatggggaaaagatgggtttaattatatttggatggagagcgatggacaggttagtagcctctcagtaagaaggcctgatttacaattttataggaccattctggttaccaagtggaaggtggtgtgaaggggtaacgtgagaaaagcagaacgacctgggagctcagacaagaggtgaaagcagacatgggccaaagccatcagattcatagcacatttgtaagacacagaagaaaacttgctgctggatgagatgcagggtgtgagtcgattatcgaggaaaatgctcttccaaaagaagtaaacgatataaatgatggaacgtattacaaaacccaacccgaaattattgccagtatcagagctaacaattctaacctgaatgatcatccatctccctaccccctacaaagagtcattcatgagagaccatgagtctaaaacatcattattgaataggacaaagcgtgaggtctttctcaaaaagggtccttatcctaggcatgtttcatatcctgctttgctaaaattgcctctttgtttaaaattatgaaatcatgttttgaacaaatgaatgaaattgaaaattcatatgcaatagctctattgacatgggaaaataacgtgtttgtgtgaacatgattcactcacactgcctcttcagatacgaacaaatcattttgtaacatcggtttaattccatctttctctccatattgtaaagattatctttccaacttcacttcagaataatggttattattattgtaaattgtagttcttctccccttttttcttagtcattatatagtagttgattatctctctttctgcaggggttgaggtccccatttttatttccaatttgtgatttccagctccgtattttacagtattatattttgtgcactcggctattgtaaaatgatttcctattgcctcttttgggggcatagatttgtagcaatttagccttttttatccattcttcccagaaggcagtttgctgacatttatggagtttgaactgttacagagagtgagatgtgctttgcataaggacatttctgtcattgttcttgaggttaatgctatgtgggctccagtggccatgctgaaatggagtgtgaggtatgaatcatttcattttgattttttcagtgtatcagaaaaggacaaggatgtattgctatgctgctgatggtaccagaaactcttatctgatgatggtgatgaagatgatgatgatgatgatgatgatgataatgtactaattatgttctgcgttcagagacaggggaagcttttgggtgactgtcattaatcttctagcactgacagagactatcaaatggaataaggtagggtagcctcagaggaaggaaggaaggtcctcctgcaatcatatgcagttgtcaggaataagtcacccctctaactctttatattgagcctctcgataggggatatgaaaacagagagaggtactcaatgtctactccgtcattctccttcctccctggcaaactgctttcccaaataccagatagggaaaggtcccaaacagcagcaagattcaggactattgttgcaaagtaaatgtggttcttggatcgatataaatatctggagactctgaaaaaggccaagtgctttacttcagatagttgatgcttgagagcaaactgcacacagtccttttgaagtcaacagtttatcagggcattacagatacacacttcttgggccttcgcgaatacactcattgagaggcaatttgatgttatatctttgtcttctctagagaacgttatcacacagatgtcgatttgggtagtgtttttataattttgcaaatgaattattgcacattgcatctactgtcactcataaaagcccacacaatattccttgaattttaattcgagaagtagcaggggatcaggggaaggaagagattcacccctaggaataaatgtgtatgttttctcttatcagcaaaaagtatatctatgtaggtaaataatgaagacagaattatacaccttttaagagttatgtttttgttgttgttgttgttgttgttggctttgaacagagtctcactccgttacccaggctgaagtgcagtggcacaatctcggcacactgcaacctccgctcctggattcaagctattctcctgcctcagtcttccgagtacctgggattacaggcacgtgccaacacacctggctaatattttgtattttagtagagacaaggtttcaccatgttgcccaggctggtctcaaactcctgagctcaggcaatccgcccgcctctgcttcccaaactgctaggattacaggcgtgagccaccactcctagccgagtcatgttttcaacccataagagttcataggtaaaggatatatacatatatatatatatatatagccatcaacaaatgttgacctaaatttacaactcaagcttcccaaactactcaatatgagcgctcaggagtaccaaattcttcagggttttctgatggactttgtcttcatttattctttatgttttatgttgtgccttgtcttcatttgagcgttgcctcacagtcttttggttttcagctgacacaaacatcaaattagtgagaaggaaagtcttttgttggggctgtttatgcctggtctctttgagagtctcaagtgtcctggggtgtccagaagccattttctcagttatgtttctcaggacacaattctgagacataaggaggcctaactgccaaactcctctttgggcttcctgccatggattgtatttcatttctagataatacagcgaaaatagagccatccatacattgcagtatcatagggctcaatgactcattagacctatgaagaaaaaggacacaaaaggaaaaacataaataaatgcaaaaactatattctgaatgatttggttcagtggataacaataattaaaaggtgagctcacttgatgaatttgggggaacaaccaaaagatcatcaaaattgtagatgactcagaaatagattaaaaacagacctaacaggtcacagaatctgaatttctcctctccaccttctaaacatgcctcgcgattttcttaaccaccaaatctttctcctgatcatagacaactctcacccaggttgtcaacatatataaaactggttaaaatgatgagaggtcttcaaatttattcagagtaaatgctgctttaaaaatggtcatgcagcattgaaaaacgatcatgtggaaaaaacatacttggactgaagtgagactatataacctgtctgatttgggtacaaaacagtcttatttcttccaccttggtcacagtgacaatgataatattattattttatggattttctggacatcttccatatgcacagttggatggttatttgatgcatttatttttctgagtagctgatattaagtcaattcttgctcttgctacatgaaactaagagcttttctttcacagtcacataccacgggctctggctaaccagcatgcagggtcacagtcaggtcaaagaagcatcctaaacccaattgtgtcttaattttagaaaatggaaaagatcaatatactccatgtagaagaatagtgtattagtctgttttcatgctgctgataaagacatactcgagactgggaagtaaaagaggtttaattggacttacagttccaaatggctggggaggcctcagaatcatagtgggaggcaaaaggcagttcttacatggcagtagcaggagaaaatgaggaagatgtaaaagcagaaacccctgataaaaccatcagatcttatgagacttattcactaccacaagaacaatatgggggaaaccgcccccgtgattcaaattatctcccaccgggtccctcccacaacatgtgggaattatgggagtacaattcaagatgaaatttgggtggggacacagagccaaaccatatcaaataggtaggtacatcatggaccctgcatgaaagagagtattctacagattttaagagtcatgtttttaacccatttcagttcatgagtaaatgatcaaaaatacaatattgacacataaaggctattggtaccatctatatattaattaagtttttagagatatatatatctttaaggatagattgatagatagacagacagatagatagatagatagatctatatatgcccctcattatactctctcttgtttatctgccaccatacatagaaagagagacacagagagaaggtgaagaagaaggtgagggaagaggaggtacgggagaggaagagaaggagaagggggaaagaggtgataatttttaaaaagctgcagtgcaatgcaaaaaaaaaagcaccagcacctacagaaaacaaacacccactttaatttttcccagtggtggaattgattgttctgggacctgagtaaaagagcagggatgtctctgtctattctctctctcgagtcagtcagtgtgatgctgctggcctgtgtttgtgtttgaatgaggaaagaccttcactctagtaatgacctagcagttagcttggaggaccctggacatatttgtccagttccattcaatactcccataaagtgcctgtggtattatattagtttgctttcatgctgctgataaagatatgcctgagactaggaagaaaaagaggtttaattggacttatagttccacaaggctggggaagcctcagaatcttggtgagaagtgaaaggcacttcttacatggcaatggcaagagaaaaatgaggagaagcaaaagcagaaaccctggatctcacgtcagatctcatgagacttattcactatcataagaatagcaagggaaagaccggcccccatgattctattacctccccctgggttcctcccacaacatgtgagaattctgggagatgcaattcaagttgaggtttaggtggggacacagccaaaccatatcattccacccctagcccctccaaaacctcacatttcaaaacaaatcatgccttcccaacagccccacaaagtcttaactcatttcagcattaaccaaaaagtccacagtccaaagtctcatctgagacaaggcaagtcccttctgcctataagcgtgtaaaatcaaaagtgagctagttacttcctagatacaatgggggtacaggtattgggtaaatacagccattccaaatgggagcaattggccaaaacaaaggggttacagtgcccatgcaagtccaaaatccagtggggcagtcaaattttaaagctccaaaatgatctcctttgactccaggtctcacatccaggtcacgctgatgcaagaggtgggttcccatggtcttgggtggctccgtccctgtgactttgcagggtacagcctccctcctggctttcatgggctggcgttgagtgtctgcagcttttccaggcccacggtgcaaactgtcagtggatctaccatgatggggtctggaggatgatggccctcttcttacagctccactaggcagtgccctagtaggaactctgtgtgggggctccaacctgacatttcccttccacactaccctagcagaggttctccatgagggtcccacccctgcagcaaacatttacctgggcatccaggcatttccatacatcttttgaaatctagtgaagctttcaaaacctcaattcttgacttccgtgcacctgcaggcacaacaccacgtggaagctgccaaggcttggagcttccgccctctgaagccacagcccaagctgtacgttggctcctttcagccagagctggagtggctgggacacagggcaccaactccctaggctgcacacaacacagggaccctgggcctggcccataaaatacacgttttcctcctgggctagagataactagatgaagccagtacctggaataaacatattctttgtcatattttttcttatgtcttagtgacataaaactagacatttagtggtacttaggcaaacagttgaataaacaactagcaattagcaggaaaactggttgaacatagaaagtttagtaaccattctagtcaactctgtgttcttattttttttggattgttgactaggtactatggatacagtaactagagttacctgggtaagagttaaatacagaatcctccataaaactagaataactggttaaagacaagtataaaatttcattcttctcaacatttctcatttcttgttggaataatgagttagttctgttaatgtgtagtagtacctaggttactacaaatcaagaactaggaagagatgactagactaggataagtatttgacaccagatggtgaaaaaaaaaaaaccagtgttttcaaatagaaactcttatttcctgtgtgattaatgagttagaattagtactggagctatctctatgagatgtggatttcattttggggggtggtacatactcaacagatgaaattttgggtcatatggtagttctattttgattttccaaggaaccattatactgtttttcataatgtaccaataacatttctgccctgtaagggtccccttttctgcacaacctaaaagggtttcactctctccacacctttgccatcattactttttatctcttgactttttgctaatacccgtcctaacaggtgtgaggtgatagttcattgtggttcatttgcattctctgattattaatgatgttgagcacattttcataaacctgtcagccagttgtgggttttctttcgagaaatgtctattaaagtcctttacctattcgtaaaccagactatttttttttttttttttgctattgagctgtatgagttctttatatactttggatattaactcgttattagatatatggttcacaaatagtttctcccaaaccataccctgccttttcattttgttgattgttgactgtgcagaagcttttagtttccaggctgctcacttgccctacatatttcagcttcctagacccccacaatgtgtgaatgtgtgagccaattgcttagagtaaagcatatcgtatataatattattcataaataaataccatacaatagtaaatagatgtttatgacatatattacacacacacacacacacacacacacacacacactcacacaaatatcctgttggcttagtttctccttctctgaggaacccagcctgatacaaatacccagctgagcgagtgtctttgctgatcttcaccgcctgaagccagtgctttaaaccatgagaatgaaacattgaggggcactatgtggacactgggagaaggaagtgagatggaaaagttctttgattgcatccaagaagtgaatggtcctcaaggtgcagcagaggaatttgtaggagagagggatgattgattgacggctttttttttttttttttttttttgaggcagagttttgctcttgttgcccaggcttgagtgcaatggcgctatattggctcactgcaacctctgcctcccgggttccagcgattctcctgcctcagcctcctgagtagctgggattatgggcatgcgccaccatgcctgactaattttgtatttttcgtagagatgggttttctccatgtaggtcaggctggtctcaaactgccgacctcaggtgatccagccaccttggtctcccaaagtgctgggattacaagcgtgagccactgtgcctggtcaactgacgtcttcatatagccctccgtctatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacacggggagtttaggaggggtgacatgtcagtttgggaactatctttaggggtgctaacccaaatctccctttctccaattagagcaccctgccttcctcattagatgtcacccccccccccgcccccgacttcatccgccatgtcctgatggtgctttgtgacgtataaggccttccttcccgcccagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaaggtgagtgaccctcccaagctcctcctcgtcttcccctcgcctccttcctcacaagaagcctctcctgtcctcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgatctgagtgactctgtgttctctgatggtggggagggagggagggagggaggaagaggtggtgtgtggggagggagggagggaggaagaggtggtgtgtggggagggagggaggaagaggaggtgtgtggggagggagggagggaggaagaggtggtgtgtggggagggagggaggaagaggtggtgtgtggggagggagggagggaggaagaggtggtgtgtggggagggagggagggaggaagaggtgtgtggggagggagggagggaggaagaggtggtgtgtggggagggagggagggaggaagaggtgtgtggggagggagggagggagggagaggaggtgtgtggggagggagggaggaagaggtgtgtgaggagggaggaggaagaggtggtgtgtggggagggagaaaggaaagaaggaaggaacaagtggtatgtggggagggagggaagtggggtcccgtggggttgaggtcagggggacaggtcacagttagccagacaggaggataaggattgcgtcatggctgagcactggagacaaatttccccttcacaggatgactccgcttcttacacggtttgtttcttcatgcaatcttgctagcacatacaccaagtaccaagaactggattctacctacttaggtttcactgtcaaaataccttttcggttatagaaacctatggaagaatcgtttccatctctttcctttcagcgtcccctccctacaatctaatataattaagaagaaaaattcaaagtagagaaaaatctatctacttgaaaaaagcctttttatttttgcaactcaggagacagaaagtacaattcatatttccatacattagaaatacacaggtcttttctacatctagtagaatttactatatacaaatatatgtaaatttttatataaataaaatatacaactatatttactatagacaaacagattatatgtttacatataaaatatatacatatagacaaaatatggaatatatatttatatataaaatatataagtataaataaatgtaaatatagattatacacattagaaatacacaactcttttttgtacatagtagaacctattatgtatatttatatattaatatatcttatgtttttatatttagattacatatataaatatttatattctatatattatatataaaacattaaacatatatttatatttataaataatatatcaatatagacatcaaatctatatatgaaacctatctataaatataaatacatgaaaatagatatatataaatatatataaaatatatattctatatgtgatcatttattttagaaggtaaggtgttgtgattgttgaagcatccttcacagattaaaaaaagaaaggaaattatcattttaagaaaaataaaataaaaataaaaaataaataaagtacaaaattcccagttgtcaataattacaatgagagaataatatagaacttgctatatatagaaagtatttctatatatatttctaatatatatattatgtatatagtatttctaatgtgtatatatgtaatgtacatttatatatataattatataaatgcacagatcttttctatatatagtataatgcactgctgtatttctaatgtgttatatatattaaacctatatttatatatatttatataaatacacaggttttatacatatttatataaatacacaggtatttatataaacatataaacacacaggtcttttctatgtatagtagaattttgtatagtagaatttatgatacatttagaaaagacctgtgtatttctatatttatatttagaaaagacctgtatatttctaatggatatatatatagtttgtatttatatgtatatttatagataaatatataatctctatatatttatatatctatttctatgtatttacatttagatagagatctatttcacatatagattatataaatatattctatgtaaatatataaatacatatataaatatgtaaatatatttatatttatgtataatatataaataatatataaatatgtaatgcataaagataaatatacaatatataaaatatatattctatatgtgatcatttattttagaaggtaagctgttagtattgttgaagcatgcttctcaggcaaaaggagaaaggaaattatcattttaagaagaataaagtacaaaattatcacaatttaatttccagttgttaataattacacagacagaataactcatgtcctttaatcttacaatgaatagcacgttaaacttttatgtgattctgaaaatatgaatttccatataataagggtttgagatgtaaagcactaactttataggcagttttcacttgttacatagattgttcttagagctttaaagatgttaaaattaatggtggctttgaagagatggtagcatcatttgagaaacaataaatgggttctgtttcatcctttccttggtgcagtcagggcttcacttcattagcttaggaagggatttcagagctttgcatgttgatcttgtagttgcctcctgtggaatcctacgaaacctaggacgctataccacagaaacagggccttgccccatgtcctgaacaccatcattttgtggtatatttcttttgtattatttcttatatggaaataccatataagaatgagcatgcttggtataactcaaagcctgtttatttgcaaggctgtattgaccctggacaataaatatttgtatgttacggatgagaaacaagtctgcatgaaaagctcctgctgtcttttaggaaagcgtattggctgtggttgtatatctctttccaaagggaaattggtgaactctctgctatagttttttccataatgacagcataaaaactgaaataaacttatcttgtcagtggccacttttggggttggtgtatattagggagcacttttgcaatgtgtttcaaaattacattcaaggattaatttcatgcaccttattttaatgccatatttccattcaagctctgcatgtcaaaacagtctgtgatgattcttttggcattgaaataattatccatggcacttaaaccgtgtttctttcatcatttcatggcagtaggagcttcaactgctatttgttgggaacccatcctgactagctctttcactagggcttcatgttttattgtgatgattggcagacttgtgtttcagacattttcagatttggaaagttactatgattttgaaattatagatgcaaaaatgtcattgaatttactttcacaaacttttaattcattatagacaataagaggtttaatcagaaatcaggccaggtgcggtgggtcacgcctgtaatcccagcactttgggaggccaacgcaggcagatcacttgaggtcaggagcttgaaaccagcctgcctaacatggtgaaacactgtctttactaaaaatacaagaattagccaggcgtggtggtgtgcacctgtaatcccagttacttgggaggctgaggcaagagaattgcttgagccctggaggtggaggttgcagtgagcagagattgcaagactgcacccactgcactccagcctggctgacagagcaagactccatctcaaaaaaaaaaaaaataaataaataatttaagtaatcttttaatttgttggagcattcacaaatactacatcttcatttaagtctctctttattctacatgttatacacacagttaaattagttaataagagtgttaaatactttccctccttctccaactacccacaatctcaggcttaaaataaacagtggaatgcgtaaagacccaaaataatataacagcaaaggtgcagttgacttttgtaatcaaatgataaatatcaaagcttcctgacgtttttaggcaaatcttcctgtgtccctaaaaggaggatccccttgacagcagtcatgaacaacaggtgatctgaaattctcagctgtcaaagacggtgggagaatttgaaaacaccttgtacatattaaagagctaagcatgagctgatgcatacatacatatgtctctgtctcattagaccacaggaaacaggacacatggcaggaaggctcacgtcgattccccttgaccatgcagcttcctctgctcctgactcctaagaactttctgacctattggtcattcccagcttcagatccccacgcataccgattgtttttggccccacgtcagtgatacacacgacacagaattgctctcaaaaaacactctggaattgaaaaatgacaggggaagctcaacgcgatggctgggtgccagagggaaggccttccgctgttttgaacactgatgctaagctctagaataactgtagctgcagcctgttggacctgggcatgtgtcaggcagggtgtgaaatgctccccaagcacgacctcatttctccctcacgttacccctgtggattaatcggggctctagagagacaccaccaacaggttatcagcaaagatagatgagaggggatttattaggggaattagagggtgaaaagtctcaggacaggctgtctgcaagctggagcccctgggatgccaggagcgtgactcaggtcacaaccaaaaacctcagaactagggaagtggatggtgtaattctcagtataaaaggagcctgaagttctggtgttcaagggcaggaaaagaagaatcccagctccaagagagaaagggaggaaagtgcctttcctttgccctgtttcttctatctgggccctcagagaattggatggggcctgtctctattgaagacatcttccccactctgtccaccagctcacgccaatcttcccaagaatacctgtgcaggctcacctagaaacaatgctttactaattcctgacgtattccttaaggcagtcacgttgacacctgaaattaaccatcacaccctgtaaaatgggtagtgtccccactggacaaatgagacagacagtttgggtacctttcttatactgcttataggttatagagccaggattaaaactcaggtctgcaaagaccaaattctaaactccaccctcttaaggactgctgctcaacactgtggaagcagtactgcattagacactgtacgaggattgaagaggcattcgagacacatcccctgctttagggaccacatcttagcttgcattcatgacaggagtcatgtttctgtgactctactatagaccccggaaccaagtgtgaattggtacgctttaggtgtgcatacgctctgcagaaatcctaagaaagagccagataattataggctcgattcatatagggaagtttttatgaaaacagcttttagccaattcctgaaagaaaatatttttactggcagaaaaatgttctgctagagaataactagttgaagggctttgggggaaggggctctggacacatgtccacggaagtggggaaaaaagacacacagaatagaaacagaattggggacccttcaggaagagaagtaaggaaaagtgctagcccagtaagccgatatgtaattttgaatcttaactagattgagaatttggatacaactcaaaactagaaaagagtaattgcactaaaaaaaaatggcgcagagcagggtaaattaaaataaaaattcattaataatgaattaaattattcattcaacaaacatttattgggcaccttccatggtccaggtagagggctacatgctaatcaaaaaataataatcgctgccaggactgagcaatgcctgtgagtcatccttagactggtgctggaagatagatggggctgtcttattccatcctgagtttacaagagatgaccctgaggaccagccaggctaaataaccttttccagatcacctagtacttgaaccgaagcttgtctgactccaaagcccacacgttctctgatacgccatgcagccagaaaagggcagtgaagtactaaggtttgctaaggtgttgagtatatggaataagatactcaggagtatttttaaacttgtggtaaaacacacacgacacgacatatacactcttaacaaatgttgaggtgcatggtacggtattgttaactatatgcccattgtcctacagtggatccttacaactttctgggatggttaatattgtcaacttggttgggttgaaggatgtaaagtattgttccctggtgtgtctgtgagggtgttgacaaaggagattaacatttgagtcagtgcactgggagaggcagaccaaccctcagtctgggtgggcaccatccagtcagctgccagcgtggctagaataaagcaggcaggaggtgggagaagccgacttgctgagtcttctggcctccatgtttctcctgtgccagaagcttcctcgaacatcagactccaagttcttcagcttttggactcttggacttacaccagtgtttcgccaggggctctctggcctttggccacagacagactgaaggctgcgctgtgggcttccctacttttgaggttttaggacttggactggcttcctggctcctcagcttatagacgggctattatgggacttcaccttgcgatcatgtgagtcaatactccttagtaaactcccttcatatatgcatctatcctattagttctgtccctctagagaacactaatacactttctcgtcttgtatgactgaaactccatgcccattgcacctcaattccccattttcccctcccccagcccctagcaatgaccattctactttctgtgagtttaactattttagatatttcataaaagtagaattgggcagcatttgtccttctgtgactggcttgtttcacttaagcatgatgtcctcaggtccatctgtcctgtaggagtggtttctgacatcctacaaagtgagagggttttgaaacttgtgagacatgcacaaaggtggagagactactatagtgatcaccatgttttcatcatgcagctccaaccactacaaaagtcagctaattccatttcacctgttaccctctccaaacctgacctatcccctgcccaactcagttattttaaagcaagtcctagattactttttaagtaaactgacttgggcgtgtttaagaatttgcctcaagtcagatggttttgattttttaattttttcctggtgacaacagtaatccaagattgagtaacaattattcaagccttacagaagcacacagagagtaacattttatagatgttacattttatagatcctcagtgaggatctatattagctatgtgatatatgccactgtaaagctctttcccaccctgtccatgtgctaatgttgacctcacaatgttgtgagcttacgttgctctctaacgctgttcacttaacagtatagccagacaatgatttcatcatggaactgaagctgaagatgctgttccaacctctgcctgttacccagttccaatgtcgcttccacatttttcaggtaactattcagcaactccccactctattggtaccaatttaccatattagtccattttcatgctgctgataaagacatacccgagactgggaagaaacagagatttaattggatttacagttccacatggccggggaggcctcagaatcatggcaggaggtgaaaggcacttcttacatggcagcagcaagagaaaatgaggaagatgcaaaagcggaaacccctaataaaaccatcaaatctcatgagacttattcactatcatgagaatagcacgggaaaaactggcccccatgattcaattacctccctctgagtccctccaacaacaggtgggaattctgggagatacaattcaagttgagatttggatggggacacagccaaaccatatcaggtattatatatataacataagaaatacatgtttagtctctggccctcagttccttgcaccggaacttgccaggaatgcctaacaacctctaggtagaggtgctaggagaatcttttgttctaatattttgtatttgaccctcagttcctgacacagagcctttaagtccctaggaatgttttgggtgataggagcatcttttgttctcctggtgggctcctgaacagcctcacgatggaagcagattgccagggaaaccaaccatgtcattagagggttagagctccctctaggaaggggagagcaactgaaggttgagttgatcacttgtcttagtccattcagggtggtataacaaaataccttgctggaggaggaagaagatgaaggaggagaggagaaaaataagaagaaaagagggatgagaagggagaagaagaaagagaaggaggaggagaaggaagaagaaaaggaagagtggaagaggaaggaggataagatgaagatgacaaggaggaggaaaaatagaatcttaagagacattaacaaatgactatctctaagtgacaacattatagtaacttttactgttttttattttcaagatttccaaaatatcattaactattgtcgtaactggtactttataaaattaagagagtgtaacaaagctgaaaccccaaattttgtgaaaagcaagatgcataggagtcaaaagctgctattaggaaaaaaaaaaatagggacagggccccaagcattacatgaggttaatgttggttgttttctgatgaacacaacacaggagaatgtgaggatcaggcttgaggctctacccttactttcagtaataggggacaagaaaatgtctgcatcaaagaatcaaggttaaggataaagaggtttccttttaagcaattctgtgggctcactgcatccccagcaagatccctttatttagtttcaaggcatggaagtgtcaaactgtaagttacctatagtgtaataccactcagactaaatttagaccaggaagcgtagtgcactcaaagcaagtaagcattagtctaaaagtgattgtcctactgacagaagacatgttgttttgctaccttttccccacaaattactgtggtcctgtatatcagttggggagaacggcactattcacttaggacaagtatgaagaaaataattgttaaattgttaaatccttacctttggcacccacccgaagaactgtgcttttacacaaatgaacacgaatgaatacgacttttgaaaacagagcattcttactccaaggtagtgtgttagtaggaaacttagatgatcttgattgtacttcagcaaaggcatgagtgccaggcagatgctgttctgacggctctgtgtggtctgacagctggttgaggtgccattggcattcatttgagatggtcacctgggaaaccgaaattaacatagcatccctgaatcaggtaatcatgcaccatcctttaccaggtagccactttgggtttgaaccaaaaaaagatgagcttgaaaggtgtggagcctgtagtagtgttacttgaaaaagaccttgtcctttatctagttttgttggcacaagaaaataagcatatttcttgttagatctctttttacgctagctatcaggaggatagttaaactcttcatgcagcatgacaaagatttttttcagacatatttcagatagctgagattcctttctttgacacacacacacacacacacacaaacaagtatacaaagcatatacttgtatatattttaattttatacttttgattcctattatgttaaatcttggaaatttttcaaaaagcattttaaattatttagctgttatttttgttttaatactgttattaaacaatttctgttgtaaacacattttcttatctccaaagatagcacacacttagtcaatgtttcttatcttcttggtcatcttctcctcttccaaatgttgaactctcccaagaccccattcctgacacctgtttttcctccagctcttctgcctctgcagacaatgttatccattcccatggttgtgtatagcgtttatatcacgatgaccccaaattcttatctcctgttctgacttctcctctaaagtcctaaatcctaaatctaactgcctaattcgtatctacatttggatgcctacaaggcaactcaaaatcagcacgtccaaaataaagctattggttctagatcctacacaaactccagctctcttcttcagtttctgtgtctcagtgaacagcatgtgcacccaggcatatacacgtgattcctgtctttccctcatctcacatccattaacaggctgtattaataactcttgtcagctctggttttatattatattccacatctgttcaattttcttcatttccactagtgtcaccttattccatgcagccatcatctttcatcttcgttcttgcaagagtttcctaaatggtcttccagacaccattagctgaaaattcccatactttgggttataaaatattattccttggatcaaaattctccagcacttccaaacatactttaaaatggaagcgaaactcttacctagccgagaagttcttatgtgactcgggcttatgcccttctgcaacctcattccctctcactctcctctcagtcatgattccttcagttctgttagctcaatgttttagttccttaaacactcaaagctaacattcaggcctgaacactcaggctaaacactcaggcctacagcctgttttagaagctgctccctctgcctggaataatcttccccagtatcttcatatgtctgagttcttctcgtcttttagattgcaatttatatatctactccaaaaaaaaaaagaaagaagccagccctgacactacaaaatgaagccatctaccagtcagtcttcctaacatttacctgacatatttttttcgtgtcacttattacttactatttacttgactttgaataagtcatctttttacatttcatattctctgactttaaaaagagcatatttcataaagttgatttgagtattaaaggagttaatacacatcaagtgctgagagtaaatattcacagaagcaatcaatttattcttccacacagcagtcagtaaatgttggtggactagtattaactatcatattattcaggatatgaactaacttgttttaaattgcagacgataagtattaattctgccatgaagtgcccgtatccaattttcaaatcaccattgctgccttcacactcaagcaggtcagatggcaaaagccctaaaagtgtatagctaaaattactacacaatgacactataaccgttcttgcatgtgtctttggtaaacacatgtacccacttaggttggatatttacctaggaatgaaaatactgggtcgtagagcatgcatgtattcagcttgtagatacttctgaacagtttcccaaagttctttttccaaaatacacatttatactatattttaggtatagtcaaaagattttcaaattagctatcataaaaaaaattatctgagaatataatccatgtgacaaaacatattcctattagctcaaaagattattataattagaaagaaatatatcagcataaaaatgatataggaattacaaattatatatcactctacatttgtaatgcctatatcactgtttggaatatctcattattttaattgtaaccaattactccagttggaagcgtcacagcaagcagtattatatattttaggaataaattgaatatatcatccaatatctcatcctaacttcctactctttcatttattaaagcgtcaaagttcccattaatgctcataagaattttgaatccacataaatatataattaagctgaaggtgaatatctttcaggtggatttaccagcaagtatgaatgttaaaatgatagctaatatacatttctacttttaatttattcagtgcagttatgatactgctacaatactcatattgttgtgccatctataaggtttaaaaataattaacatgaagatgatgttctataattgttttattggtttttttattgtgtgcaaatctaatattgcctcactattgactccctatataaacaaactattttccaattccttacagtagacaaatatgcttattcaataagagaaatgaatatattgaaaacaattttgaataataatatcttgtatcttaagacacaacttcaaatattgtggcataaaaattgaatctaataatgtgcctttctagtggactttactatcaaaataaaaattcttagagttaaccttctatggtttggagatagcgctatcataaactttgttactttgttgtgtttttttaagactctttccccagtctacggacacaacatatttaatctgagttgtatgtgatgtgtggtgtggttaatttattgccccggtttacgtaaagtgtgttaattatatttaatttggcattttactttcactgtctaatcagattctaactatagaaattgacaacttgtggctaaattcattctcttcttgtgtttccaattgtgttttcattgggctcctcctttgtgtcattttttgtatgtcttttgatttggtcttactaatttacctggacgaaggagtaaatcctacaaaagtacaaatacatttatcatggtctttatattgggagaactaatcaattgggcttcattttttagaatttgtgtttttcttatgcaatatgggtttagaagtggatagaaaataaacccatttggaacatatacgaagcccagtgttggtctaaacttcctcacaggttacttgagtcctgatccatcacaaatacaaacacatttaaaaacataaagcattattacaatggaatcaaaataccatgactaaatccattttcccatcacaatgtcatttcttagatgaatacaaacaatgttcatattaaatagccatttctatcatggatatgagtttctggtgacttgtctttgcataataaaaagatctcatttttacataagcaaaacgagcaccataactttgcataatttatgtttgtatcttggctttgctgagagttagatacaatggaaggaacaagggcatcgaaaccaggcaaatgtgagttctaaaccaagctctgacatgtgacttcaaattgatcaccataccattctgagctgtggctccatcttatgcaggatggagacaacaataccttgaaaaaatatttgtaaggcacttagcagaccataaggtgagttgcccctcgaaatgcttgtagcaatttacaaccttccattaccatttgataattccactgaattctctaccccactgcccatatccaaccagctgttaagctgttgctatttgatctggaataaagtcaaaagtggctgtatggctttgaatgcccaggtggcaaggtggtatattagtcagttaaggctgctataatgaaatatcataaactgggtcgcttataaacagcagacatttatttctcacagttttggaggctggaactccaagatcaaggcatggcagattctgtgtctgctggactaaattcctggttcacagagatggtgccttcttgttataccctcacagggtggaaggggcaagggagttctctggggtcccttttataagggcactaatcgcattcatgaagacattaccttcatgacctaatcaactctcaaagcccccaactcctaatactatctggtgggagttaggatttctttttcttttctttttgtttttttttgttgttgtagtttctttgagacagagtctcttggttgcccaggttggagtgcagtgccaagatcatggctcactgcagcctcaacctcccatgctcaagtgatcttcctgcctcagctcccccaagtagcttggactgcaggcacgcgcctcctcacctgggtaatttttgtatttttagtagagacagagtttcaccatgtttcccaggatggtcttgaactccagagttcaagcgatccacccgccttggcctcccaaactgttaggattacagacatgagccactgcacctagccagaggttaggatttcaagaaaggaattttggtgacataaacattcagtctgttgcagtgggtgataaaagatgatgctgacagtcttgcagggtctattttatggagaccccaagtgtcgtatttaattaaagctagtctttactctaaagggcaaaggcctttgaatgtgctcttcctttgtctggatgttctgctattctgcattcatccatttcctccctattctcctctctggattatcacatacgtaatgccaactcctatttcaaggaaacaacacatcttttccaagatggaagctttttaaaaaaaattttctgccacatttcatctgctccatttcaaattgctggttcctgatagatgccactttcttcatgaagtttgacttgcacctgtaactgatttagggactgtattagtccattctcacactgctatgaagaactacctagacttggtaatttatgaagaagaaaggtttaattgactcacagttccacaggctgtaaaggaagcacggctgggagccctcagaaaacttacaatcatggcagagggtgaaggggaagcaagcacgtcttaccatggcagaggaggagagagagagagacagagtgaaggtggaagtgctacacagttttaaacaaccagatcttgtgagaactcatcactatcatgagaacagcaaggggaaatccactctcatgatccaatcaccttccacagggtccctgtccccacattgggaattacaattcgacatgagatttgggcaggaatacagagccaaaccatatcagcgacctttcaggtgaactcacatgtacttacgtcttcagacattcatcatatgacgttgtagaagcttttgcaaatgtgtctgtttctccccatatgcctgcatcccaataaagacagggatggctttgccgttgctcaccatcatattcccataattctaccctcctctccagttagttctcactattctcacttccaagaccccagtcccaccagccttggactttctcttgactaatttactctcctatttgaggactcaagtatcattctttataggtacaagccctgacaaatactgattggatggcacaagaaagtgagaagtattatatataaaggacacagaggcgttttggccacacttggcacaagccctggtcacaacatagtctatagttgtttctgccattgctgcttagaattcatttcatttttcttccatttccttttcagtgagttttctagtttcccccaaaagacttatttaatcatggacattggagtacttaattaatttctattaagcatggtttcaaaatatctaacacttacatgcagggtccactgctttccttcactgacttccctggtgaatattgagctatttacctacagagcaggaaatacacatggtctcattaatctctactctgcctaacccaaacctactcccccgcaaactcaatgtgaaacagattgagtattcactctcatatattatttggagagtaccattgatttatacaactcttcctcggtcagaagggtagtgattcattggcccaatactcaatttaactgcagggaaagtttctatttgttgagaataccatttcccaatgcatacaactgttacaggggggttcatctggtttagccacaaaaggactctctgcaggtgtaacaatctgaaacataggaggactattttgggaatattgtctaagaatagggtaatagttcaaaataaattgaaacaattattaaagtgaaaacatttaccctaagtcagaaattatgctattaccaatgtgaagaaatttaaaggcaatatggaccatatctccagacttttcaacaataatgataaacaaagacacacgattaattcagaactaccacccagtctctaagtaatttttctattagacaagtgcctacttcttgctaagcagttcgcagcacacttttattattgttttcttgtgtgcatatcttaaatattgatattagctcacctaacttcctaaaattatatgaacactcaaaatctctactcatattttatgttttttaaagtttaactaaaaaaaataaaataaatatagtttagagaaaacaataccttagtgccaaaatcttaaaacctttggtaaagaaagggctaagagcagtttaggaattctttttcttgttttactggggacgccaagggaaagaaagaaagatgacttgggcaatttacctgtaagcttgcaaatgtcagaccccttggaaaacactataattttatctcttagtgggagataccattaccaagtttttatgatccacttttagcagactgttgtaactggcctggttagtattgtttatagacttagggacatggatttctgaaaaatgttacataaactatgtaactgagtctaattggaaatgtctcatgaaagaagcaactcccttctgcatgaaaggtgctctcacaagcactacttagagaactcatagttggaacccagagtcagaacgtgtcctaatgaaagaagaaaggattcaaggaggagtgtggatggtcccaaactttgttttggctgtgtgaaattattagtagcatttgccactgggcaagatttcagagtgaggctcatttagtagtccaatatgtctaagctctatgctgattttattttagaagatgttccttacttttgtccctatttattttatattttaatattttatgccatagcattcactatctttgacatattcgtttgtaaagatggaaggctcaaaatcaatgtactaagcatctaacatcagaagaaaaaaaagaagaaatagtagagatatgctcctttaaggatagttttcctctttcttctgagtctcttgttttttaatctctattttgtttgcctcagtctatacatcatgttaaaacctatgtcaactatttggtcttcctggactgctcattccatgttgagagagacacactaaaatgtcagttggtagctcctgttttctaatggtgacctttatggtacaataactcactagaaaccttgctatttcacaagatgaccatcactctcagcatctaaatttttttcctttgggttggtcaatttcttgagagaggaattctggctgttagcagttggtgaacagaggaaaaaaatcaattaatgattgtgtataaagaatttaacctaattcagacttgcaaggttaagaatgtttactttgaaaaaaaaatcaataatcatgttgatatggaattttgcactaaaaatgcttgagggtggcagccaataaagcaattccttcaaaaaactatgagaaagttattctccacctagaacattacacaatgccaggtaaagttaccaatcaaatctgagcatacaatacaaatatcttcacatatttaaagtccgaaaaatgtatcatcttttctgaggaaattactaaagggtatgctttaccaaaacagaaaaggactgagagtaaagaagtcatagtgccaacacaagagagaaactaaagaaactacaggagcaatggtgataagaaattccaatatcaaagctatgcagcatgtccagaggcagtgagttcagtggttcaagaacatacagatgtttttggttattttgaaaacagatgtatatttctgtgggagaggcagagacaattcaagaagagctatataaaaattagacaagtaaacaaaaggcaattactaactccaaggaaaaccaaagagatgtactagaagggaatgcaatcattgttcatcatatggtttgaccgtgaataattgaaatatagccttaataacataagcaaagtatacttgatttagccaattcctgtgttcattatcggtggagagggagtgaaagaagcaaaatggtagcggaagtgataagagagataaatcaataagtaataggtggataatatctaaatccaaaaaaaaaaccataagcttgctattcaaaaaaaggaagtaaatatcttgagaaaacaactaaaatagttaaaaatgcgtgcatttgcaatgccagaaatggagaagagtgatggaaagaactactggtttttattgtagtccaattaggacaatttcattaaaatatgcatacataaataatattacatatatatataatttcatttatgttgaaattaagcatttttacaaaattaaaggttgtgactgccctgagattttttcccctatattgctaaaggaatacacgcattgttacatgcaaatgtcagtttaatttgcataatctttaaacatttttcaacctctaagttttggtattattgggcaaggctgtgtcctttcattctagataaacttctcctttgtggagaaaatctgtcaaaatctggcccattctttctcagatttcattcaaccctcttctcccatttccttcaccttggccatgatgaaaccgtccccaatattttttatgctctgcaccttttaatatcaaattccttcacctgcccccagtagaataaaaaacttggaataagtttttttctaagtttttaattcttcaagaccaattaaaactaaggctcctttcagatgaggcagtcaattcccctattaccttcctctgcccacaatactttatttccattctttctcctttctcctgagaaagaatagttatttattcacatgacactctttctgaaccaagatgttcaaaggtagagaccgtgtcttattcctctttacatcctttgggctggactagcacactagctggctcccagcagaaatgcaggcaatgaacacattgtgagtaagttagtggggggatgaccagcaaaggtgcagtgtaagtgtaagtcattcttcctcttctgcatgtaaaatctgccaggagcgactgaatgcagcgtcccaaaacaaatatcaaaaactaacctacaacaatccaaaccattgttcgaatactaaatttttatgaaccacagaagtgaattagctcctttatcaatttgcaaaacattcaattttatgtacaaatataatatcattataatgagatagtttcacaggaactgtctctcagcagaataaaattgttgctagaaaggaaatcaaacaaaatattataagatgtgtgtttgttcactcggaatgaactttctgaaatacttctcttgaaatatcatttatatctcacacttaatttgtctatgccgtctcgttacatattattcagatgaaatatcaataatagaagttgtttctgaattttacagagaaattatgtgcaaagttctttgagttaatcgtgagctatttttaaacttctgactgttaatgtccagaagggaatgctaagttgcagtattttctaaacagtgtccacatgtttacatggaattttggcttctcttcacctatcactcaatgctgaattgttacccttctgtcttcagaaaagatgaatggaaagaaaggacagagagtccaatatttctgtgaaatctctgaccagaagtgccgattcttcacttattttattttttatttttttagagacaaggtgttgctctgtcacccaggctggagtgcagtagtgtgattatagttcaacgcagccttgaactcttggattcaagcaatcctcccacctcaccctcccaagtagctggaactacaggtgtatgccaccacacccaggtaatattttaaaatttttgtagagatgagggtctcaccatgtttcccatgctgatctcacactctgggccttaagtgatcctcctgcctcagcctcccaaagctctgggattacagacatgagatactgcaccaatcctccccttatttttagatactcagcatccaatacactacttgtgtgttgcatggtatatccttgatacttattttaatgaataaatgcactaaaggaatgtgcaatctctacagatgaagaaaacccagtgatattaaacatgttattagttgttataaactgtattttatatccccataaaatcatatgttaaatctctaacccccagtggctgatatttggaggtgggggcctttgggaggtgatgagatcataagggtggtgccctcaggatggcgttagtgcccttataagaagagacacaaagtagcttccttcttcttttccttctttccaacatgtgaggacaaatagagaggacagccgtctacaaaccaggaagtgggttcttttcatcagatcttgagtgtgctggcatctcaatcttggacttcccagtctccagaactgtgaggaaaaattatttgttatttaagccactctgtctgtgacttgttatagcagcctgtactgaccaagacatactaacaaattatgaataggtaaaacacagatgatttctttttcttctttttactttttgtatttctgtatattactaaaagttcttaaaaatcctctgaggaccctctactcaaattgtggcaaaaagaccagctgcatcatggatatcacctgggcacctgttaggaacacaaatcctcagtcggctctccaggtctactgaatatgaatctgcattttaacaagatcccctggtgttttagatgcaaaattcagtttgagaagtactattttaaaagagtttgctgtaataactcgtaaaatgaatctctccatttttaaaaaaagtacctgatattgccattaactttttcttttcttaatgtaaatcccaagtattgagaaatacttggggaagggtattactgcctacttgactgagccattgagaagttcatttttcatacaaccttgatgatggtgaaacacccagccatttggttgcctggggggagggtattctggggagaggaagtggaagcaggtattgcccatgccttagaagggcaattggagtgttcaaggatcagcaagaagcttattttggccggattagaatgataaagggagaaagagtaataaagtggtgggagggaagtcatgtggggccttgcagatctttgtaaggacattgatgtttactgccagggaaatggggaattcctggaaagctggagcagacagaggctggcatgatacattctatcatagaacagtgtctctctgcctatgtgttaatagtagtctacaaggggaaacattggaatcaggaatccagctaaaatgtgaatgctgtgcctccagggtacaatggagatggcttagagaaggtaggagagaaagtgggaagaagtggtcagattctgcttgtacttggaagacagactctataagatttcctgaaagatcagatgtaggttgggaaggacagaaagagctcaaaaataattcctgagtcttcaattgagtcattgacattaattaacatggaaaacactgcaagggaagaagggatttttactttcttctttttccatttttgttttgttttgttttgttttaatttttggttgtggtgatgacttctggttttgacatgttagattgaggtgaatattagcaactgtgtagaactattaaggaagagttggatgcacaaaattagagttcaggtgagaggtacaaattggagataaaaattttgttaccagcagacaaataggatttcaagtcattagtctagataagaccaggatgggactgtgtatagatatgaaaatggaaacattcaaagggtaaggctggaccacaataacatttaaaggttgcgtagataaggataaatcaataaaggagtctgggaagaaacaacaggggaggtagaaggaaaagaacaggagtgtgaggcatccacaccaagaaaacttcctaaggtaagaagagagatgatgactgtcaaataaatgatgctgtaggtccagtcagctgaggtttgaggttggcattgcatggagcaatgtgaagatcattggtgattgagaaaaacagcatattcactggtcagttgtgaagaaaacctggtttagaagaagaaattgggataagaaagagatttatttgcttccttccttccttccttcttcttttcctttcctttcctttccttttcctttcctttcctttcctttccttccttccctccctccctctctctctctccctccttcctcctctccctccctcctcccctcctgcccccttcctctctcccttccttctttcctcccttcctaccttcctctcttccttccttcctgcctgcctgcctgcctgactgtctttcttcctgttagtattgtagagttctggcttgcttccaaatgtagtgatctagtccttggtgacaagctgataatgacagagagagggagacttgtcaaagggatagagaggtccactctggtgtgaacgtggggtgctttcattagatgggagcaaagatggtttgaaatcacaagagtgaaggaaagaatgtgtgggcatgatggcatgtaggtgggtagagtggaggtcagagcttgtgtaatctccctactgatggtttggattttcctagtaaaatgggaagcaaggtcatgcatggaaagtgaggataggagagagaacgtatcacagtattggacatttctgaggagacaggaacaggtgagaaataagactttaggtctgtgctattcagaatgtggtctatagaccaccagcatcagcctgacttgggagcttgttagaaatgaagaatcgccccaaaacaaacaaaccagaatctgcactttattaagatctccaagtgatttcaaagccagcttttctcaaatttgcacactggaatgaatcaagactattctaaaaatctgcatgcccaggtcacacccaagaccaatttcataacaatattctggggattgagaccccagcatcagtagtttttaaaactacctaggtgatgttaacatgaaatcaattttgatgaccgaatgctctgggtatttaagcaagtaaataaactcgggatagcccccttgaggataatgatccttctttaaagataccagtcttctaggctgtgaatttttctccagctatatatggctgttcaggtgcaggtgtggaagaggcaatgaagtggatttaatgaaggctgagattctgccaagcaactgagaacagcagatgatgttccacttgctgtcccgccttctctcccacccacaattctcctttccaactagaacagctccctttgtatctgttctacattttagctttctgaaaaagagttaaaagcaagtgtgcaagagttaaatgcactgaaatgtatgatgcctttcccctctgtattcatcagatcaagtgtctgacaatacaatgggctcccgctgtgtatgagtgtgtgcacatgcaaggcataagattgatttttttttatttaagctagaatatactcattagtaaatctgtgtgaccccagagtcttgaatatcatttccttttttttgttttgcctttccatttcttcctttgttgatttatacacatttccaacttttctttaattcttcatttaattttgataatttgtattttctaatgatatttctctaaaattttccaatttgtcttagggatttgtacgtagtgttgccttagaatcatttaatatcttttctctgtcctattcaatttgtcaggtctaatttttaaattttctctttttttgcctttttgttgtattttatagagttttgtctatcttgctcattgatttaaagactaattttctggtcttatgtatttcagttttctctttttatgaaatataaacatacataagactaacatttattatagacaaattagactgatctgtaggaaaaggcaaaactagtcatcagagacaacctaggcatattttaaaatgttaattatatttattattttctttttcaaaatttgttttaagtttttgtagatatacagtaggtgtatatattcataggtacatgagatattttggtataggcatgcaatgcatcataatcacattatggaaaattaggtatccatcccctcaagcatttatcctttgtgttacaagcaagattattttagttattttaaaatgcataattaaattattgactatagtcactctgttgtgctgtcaaatattaggtcttattcattttttctttttttttcttttttttttttttggaacagagtcttgctctgtctcccgggctggagtgcagtggcacaatctgggctcactgcaagctccgcctcccgggttcatgccattctcccgcctcagcctcccgagtagctgggactacaggcacccgccaccgcgcccagctaattttttgtatttttagtagagacggggttccaccatgatagccaggatgtctcgatctcctgacctcgtgatccgcccgcctcggcctcccatagtgctgggattattcatcttttctaactattttttggtactcactaaccatccccattttcccctaccccccaactacccttcccagcctgtggtaaccctccttctactctctatcttcatgagttcaattgttttaattttcagatcccacaaataaataagaacatgtgatagttatctttctgtgcctggcttatttcacataacataatgacctccagttccatcaatgttgttgcaaatgaaaagagctgattcttttttatggccaaatagtactccattgtgaataaatcccacattttctttatccttacatctattggtggacagttagtctatgcatattcaatagctctctgtaaagatgcttctatgcatttatgtacagactctgcctgcctatttgtatttaaaatggtctcatatgacagtcttgattatatccttgacttattcttagtttgacagtatagagagtaatcaaggtggggatggagttacggagactgggattcaaatgctcactctgctactgctttgtgagattaaatgtagagtattttttatccactctgatgatctttcttcccacatattttctgtagaaagcagagatgatcacacctacctcacaaggatgatgagagtattgtgattgcaagtacttaccacctcaagaaatttacaccagtgtcaatggccatgttttgatctttattattgtaagcaaattgtttttcagtccctcagtatgcattttgtgtatttatatcatattttttacatgtttcagaagtactttcggtggattaaaggattgaaaaggatttaaataaataacactcctaaaatataatagccaacatgataaacaatactcaatattcaaatgtcatttttgcatagatgaaaaattctattgttttaatgtgaatttacttaaaccctttagggttaaatatttattcttcaatgatatggaagaagaatatacccatgaaacgtggataagtccatgtagctcctttcaaagcagattcttggagagaattaatccctccagcaatgacttttcttctctgcatctgccactactagttctaaaaaacattattaaaattatttttatattgtatggttgaggtaaagacccttcattaagaaagactaaatgagaaaaattaattcaacttcattcactatatttaagatgaattttccttaaacatgtttttggcaaatttggcaaactgggcatatgcaaaagcaataatttgccttaggagaattttgcattagatgaaccaaattgtgaaaagtcagttatccaataagtagagtttatgccacacagtataatatatagtgatctttatgattttcttacattttccttgtttattttttgctttcttgtgtcaggagcagagaaataggttatatcttcagctgtcacatttattttaatttgccatttatggtttcctttcaaagattcaggttttctcctaactcattaattcacacatttatttatattagttcactgtgcttttgagttttgtccagttttcttttcctatttgtagccaagtaagttgaaagaatagtgaatgtatttttgtttctttgtttaacgtagaaaacttttgtgagtatgaacttgcctctgcatacacattaaccatattctgtgcacttcaatatttagtaatttctgatcatcaatgccaccaagtgccactgtcctgtttgcccaacacgctccagtttcagcatgcttctaaatggacatagttgctatttccttttcctctttaaccctatttatttatttaaaaatatttatttgttgatgcactgaacaagatacagtagataagattggggaaatagtcaaaatctaaataaatgcatgaataaaaagatgctttacaattaagacagtgtgatattagcaaaagaacagacaaatcgatgaaggaaacagcatagagagcttaggaattgagccccatagacacagccaaatgttctttgacaaagtagcaaaggcaatgcaatggagaaaagatagtctttcaacataatgcattcgtcaagactcatagaatgtacaacaccgagagtgaaccctaaagtgtgggctttggatgataataatatgtcaatgttggggtggctgggcatgtgtcagggcaggaggtatagggaactctattttctgtacaactttgctgtgaacctaaaactattctaaacaatttaaaaagatacttcagataagagtttttgaaggaaatggctgaggttagtatagtatgataggaaagaaggggagggggcaaattttaataggctctgggcttcctctctgagggtaattaacatcctcttatttgggtaagtgaagctaatttcccagttgtcagagtttgctgctgctcttgtggggacagtaatatcattgctaccaaatgttatcaaattttgcgtatgtgtgtatttccatgtgtttaggtgaaagaatattttcaaaattattattattattttaaagcttagtataaattatttattgcctaacatgatccttttggggaagcaacatgtatatacttgctaaaacggaaagagcactttaattaatttgcatctattaaccaacattattggtcatattgctcaaattctccacatttttatgtatttctgctgacttgttctgtcaatttctgctgacttgttctgtcaatgacagaaaaagtatgtcaaacaatttagtatctttgtacttcaaaaaacatgttgtgagtgcatttcagatacacatggatgctttatcattcacctcataaatattcatgatgggaatagctccattgacattttatcttaattgaagagtgctttcaaattttgtccttgacatattttagtatcaaatgtttgagcaaatcaaactttgttccattttagaggtttttgttttgttttgtcttatttttaactttctttagtcatatgaattaggcaaagacttgaaacattcatttttatatgatttctataaagatgaaactaagtcaaattacttaaaaccaatttcagattgtgaaaacaaaatataaagacttcttagtaacctttcctagggtgatttaaacaattcaaatatcaaccaaaacactaaatgcagttgttatcattcgatgtatattaattttgacagcaagttgatgagataatccagttcgacttttaaaaagagaaaactagacaaagagaaaacatattggcatgcacattccttggttgaaatactgatatttactttatattcaaagtgctttcagtgtctgatcaaatcatggtttccattttactatctcatgcgcttcaaccttagagatcattgtatcatgacgtgtcttgtttggttgtatccatttatgtatttcacttggcacattggtacgtgttaatatgcatatttttagaatccacacagcaacgcagtaatgggtgtggtcaagtaaaaagaataattctttcagggtggaatcaccatttgtacaatgcagctgtattggaacttctttgaaacccacagcacacagctgagatagtccaatttttaaaaagaaatttactataccaattttgcaagctcaagattttagaataatttgaaaagctttgagttctactcattgcttattgtcattgctggcttaaatttatttcccatctagatagaaataaaaggtaaaaagcttaattattttgcatcatatttcattattttcttttgttagtggtaatgaaatgaaacacatgtctgaagttcacagaaagactccttggtaatgactttctttaggcatcattgagttttttcatttaatcaataattttattattttatgcagtgctttgcaaagcattcccttctgtgggtttacatatacatggatacacaaccagtctgtggttttaaaacattaattcctgtcaaaactatttatgtaatttttaaatattataaatccccatgtttacttcttattggcatgctgtctttattatattatggaatattattatttagacctgaagttttgacaaatgacgcaaacaaatctattgattcattccgttacattataggaaaagtccctgttggtagcaacgccgctgagcttcaaaacagtggccttgtcaggtaatacaagccgtggcattttcttcgcctcttttgacacatggtgtaggatagtatgcaaattggtacaattctacagggctggaggacaaaagcaaaaatcaagattaagcagggacatttcccccatgtatattgctaatacccacctaaaggtaatacaagacattaacggattatgtgaaatctccacttgtaaaattttttaaaaatttaaggggaaatgtgcttttagtttctctgacttttgtcagaaacttttcacctaagtaaagttgctcttttacttcttgaaatgtttcttgtatttatgctgagtgagtttgactagtttgccagcagctccatctacctcctgaagcaacatttgaagatgtttcttgcttttataagaatatatgcttatatacaaaggtatgctttctctctgtgataatccctcatccctcataccacttgataccacttgtaaatgcatacatatatatacatatatatatatttttttttttgagacagagtctcgctctgtgtcccaggctgaagtgcagtggctcaatctcccctcactgcaagctctgcctttcgggttcatgccattctcctgcctcagcctcccgagcagctgggactacaggcgcccgccaccacgcccagctaattttttgacagggtttcaccgtgttagccaggatggtctcaatctcctgacctcatgatctgctcgcttcggcctcccaaagtgctgggattacaggcgtgagccaccgtgcccagcctacatatattttttcaaacaaacaaaagctttagagttctgcaggctcacaaaaacctccgctgttatgaatcatgttatatttgaaagaattttaaacctatttttcagttcagttcttctcctgtggttcttatgccaaggtgacttcaagagtaatatctacatggctaatcaagttctgaaatagagattgattggtgttttggtccccacatgtccacatggcattttccttgacaaatctacaaaggcactgataggattatgggtcatggataaaggaaaccaggtctgttgtggttggtgcatctgcttgggggaagagcctgaatccagtatttttgtaggaaaggaaaccgacatttcctatgccgccatcactccctgtgtaggcaatcctcttagcaacttcaagtaaattttgtactcatttggctgataaatacatttgagttcaggaggttaagtgacttgtaagtggctgagattaggatttggtttgtctgggctcttgtgactgctccctctcttattttctgtgggagaataaatatgattaattgggtaacccatatgaccggcctgtttgtagcaactggcagacaaaccattgaaacatatctcttcatataggaaaactagagaggatggagataaagacataaaaatagcatagacattttagaaatctggatgtaaaagaggaatagacacacaaggcgagatgatgtttgattatgatacagaacagattcctaaaacacttaaatgtaattaaagatataaaaaggatagaacagaacataaaaaagttatgaatatacagcactataattagttgcttctttttgagacacagcactagtttcagacttgtccattaaaaaggaaaaaagagagaaggctgcttctgaagacaaagacaatttaaatgcagagcttggcaggtggctgccattgaggaaggaaaaacagttaggatagccttcgagaagatcctccaagtgatcaaatattgtctagagtgctagggaactttcacaattttattggcaatttaatataattcaatcgcagtctacatcatcaagacttagtatattcagttctattttgcagagagtaatgaatctgaaatttatgtttggcagtacactccagaaagtaacatttcccttgatgcatctgctctgataatttgctcatttaactatacaaatgacactgcaactgacctggaaagccagttatacaagattccaacacagcagagaccctgcaagcttctaagactttctcccactttcaaatgtcacaaagacagattcttaagagtgtttctgaaaaaaatagcaccttggaattggtccatcttcaattaaatgatggtggtgatcatccctatgaagttttgaaagtcacatctcttcttcaagaaggcattttgtgaaaggaaaccaggatcattgtatattgtaaaagaaaaaaaaaatcttaaagatagactccctttcttttgagaaaaaagaaacatgcaattttaaatcttacaaacactactgatttgaacttaatgttgactgtattaaattacaaattttaaaatgtggcttctttttttaattaattaattaatttatgttatttattttgagagggagtctcgctctgtcgcccgggctggagtgcaatggcacgatctcggctctctgcaatctcctcctcccgggttcaagcgattctcctgcctcagcctcccaagtagctgggactaaaggcgcacgctgccacacctggctaattttttgtatgctagtagacacggggtttcaccgtgttgtccaggctggtctcaaactcctgagcgcaggcaatctgtccgcctcagcctcccaaagtgctgggattacaggcatgagccaccgcgcccagccaaaatgtggcttcttttagcccctttaaattaaacttataaatattgtttttatttataaatctagaaaatctataaaataagaacgattcttttcaagggatcatttgaacaatatttgttaaattcaaattgaatagtgtaaataacaaagcagtgatactatctatgttatatgtgtgagaggggcttaatacctacatgatgggttgataggtgccgcaaaccaccatggcacatgattacctgtgtaacaaacctgcacatcatgtatatgtaccccagaacttaaaataaaaataaaaattaaaaaaagagagaaagatcatttacataagtcaagtgtgaaagcagagtttctcccactcagcactactgacatttgtctctggataattctttgtggtgggggctaacccgtgcattggaggatgttgagaaggatccctggtctctactacccactggaagccagtggtagtccgcttccaggtataacaaccaaaaatgactccagacattgtcaaatatcccccagggagtgacactgtcccagttgagaaccactatgttagaattttttcttgtaattctgccattaggaatatttttttccccttttctcatattttttatcctctgaaatcttcctaccctcacctctcagaaaatgtaagctccatgagaaccttgttcatcttgtttaacacacgcagatcctagcaacttcaatacttcttgaatacgtgaatacaaatataatcaaaataaatctgctcatgctctatttgactggataaaggatgtgattagattaataatatatgtaaatctttgtgagttcttcttcagctgtgtattaaatggaattttatttactttggataagtgaactttacaaataatatcaattgttcacacttgccctatctcccctctgcttattgggttacaaattcaactaatagccattgtaggcaaggttgtggagaaataagtaagaaacatattattatatactgtgactgctttgtggtttataaactgggaaaaactacagaatgtcaacatcccttgtcaattgaaaaggaaaaacacaattcacataaactggttgtttggctttgattacttttcaatgggatgttccaataacggaaatgatgtgttcgtacttgtggggaaaaattaatggtggacaagctcatagacttcaaaagaatgcaaattaatttaggcagtttcagggcaggctatactggaaaacaagaatgaagcaaaatgaggtatctgcttttattaagggaggtgctagagcgtgtgaggatgtgagttctaagcttgatctgaagctagacatgggccagactcagcacagaagcaaaaatctcagcaacacctgaaatctaatgtgttattcaagaaagtgtggatccagggactggcagagataaaaacaccaggcaactagtgacaaaggtcagagaaagcaggagtccggtacagagaaactctatcactggagaacagacataggggtagcaggaattcagcttgcttggatgccagagcttaaaccagcatccagatatgggagctaagagtccagcagacttagagaactagaaggggctggtggtaatgtgctcctagtctttttggtcccagtatgagggacttatttccttggaagactccctcaactgggcttctagtagagccatcacatgagaaatgttttgggctacagttgctagcaggcatgctccagcacctcaggctggaccataccctgtccatctcattgtggggttagaggaggcatgtgccatctgttgctattgactaacaggaaacttggtcctgttgtacaggaagcaaggtagggagagaaggaggtaagcagagagggagagaagaaaggagggtgggtgggagaatatgatgggtagttatgtaaagatattacatcattcatggattttacacaatatgcttaagttaaaagtatactttacaaagctgtaaatccagagtgtgtgcagagtcctttcctgtaattgttctgtggatgtcatcatgttttgagatcttcccacaatttttcagacagacttccctagaacaaagcatgccccctcctcctgttgcaatcaatactctagttcctggaacagacaaaatgtgagaagctgtagctcttacagaatgctgtttaataagaatgatttccagtctaaaagtgtgaaattttgggaacttttctatgcatgtaagctattgccagtcttctttgatgacaaactgatatggtttagctgtgtccccacacaaaacttaccttgaattgtagctcccacaaccgcatgtcatgggagggacctggtgggaggtaatagaatcatgggggcgagactttcccgtgcttttctcataatagtgaatgagtctcatgagatctgatggttttataaagggcagttccccttcacatgctgtcttgactgccaccatgtaagatgtgcctttgctcctcttttgccttccaccatgattgtgaggcttccccagccatgtggaactatgagtccattaaatctctttttctttaattacccagtctcgggtatgtttttattagcagtgtgagaatggactaatatacaaacatactcaggtgtcctttgtggagaacaattcttccccaaatctcccgtcaagacagaacctttgtgccactccacttcatgctaaacagtccaattgagagctctgccttgctgtatctatttaagaattcttgccatttcatttgccccccttttaaagtcactttcttctcccagtgctctcctgaagctgctttctctgaggcatcttatgaatttatgctggttacatcattctcacatctttggtatctccaaggaattgaccattctgttccctcccgtttggcatcaaatgagcccactcgattttcctgctacttcccttattatttacctgacaccattggtctctttgtgtcccatgagccctgactgtatttctgtgattccattgctgcaggctcctcctgatcaatcccctcatctggcagttgcttgtctcatttccttccctgcttgcctcttcatgattttgcctgagaaagcttccctgttatattccttgaacttgaatccctgggctggggggagttctgcaagaacctgagacagacaccctgtcttcttagaccccatcattccacccattatcacatcattagactctagctttgcattcactgtcacatctttaggtctatttatttcctcctgaaccactcccttcttccatgaccaccaccaccaccactccactggaaacctcttgcactgtcatagctctatcacctccaggacaacacataccaaattgccatcctcaatgctaacctttctccaaagctcccaattggattattttcaatgaaatgtctacaattcccacatttaatatacataaaagcaaatccatcttctctaggccacactgtctcaaggacttgttgttgttaatcattttcttcctcgtatcttctgcaaatagggtcaaagcagcccactccacagtgctgaggttggagctgggggtagaatggagacgtttaattctggtttacattcatgtgatgcctatacttaaagttatagtgtctcccataagaccgcgatactggggagctcttgcacccagacatctgtccccttcacagggcaagagctccacccaaatccaaacccatatttgtggtgttagccaatcctctctgagtcaaagcagtttgaaagtcccaatatttacctaattcctcttgctttaggcttttctccaaaactactggtctggcaattctttagagtctttgcaaactcttgaatcttttaaagatactttaaaatcatattttattcagatttttaaaaattactttcagtcagaaaggaaattgttttgaatgacccagctagcattcctggaaattcaacgatttctcttttctccaccattacttcaattcagaaccttctaatcccatcagagaatgataaaatcatctctaaatatgatttcttaagtcatttcttgttcccactcagtgaattcatattcatcttcctgaaatacagttatgacaccttcctccaatacagttctaacaccttcctccttccacactcagaaatggtcaatgttgttccgtcgccaaagagtcattacaaattcctttgtcacaggaatgcaagtttgtttccaggacatgccctcatctaatcttccacttttcactactgtgcatttaaaagatgcttcaaataaatgaattccacattagcaaaccttctgtttctaaatatgtttgtgcatacaccccctttcttcagcacagagtgatcttctcagcttctttacaaggcatcttattgcacatagtgcttacccggccgcccatgcaaagaagctctcctattcccttgtctcaagactcttttgccttcaacgatacttgtattaccactttgtattccaggactgtgtttaatatagctcatcattttgagtactggtatatcactattagggtaccctcatctcacccaattacacctgatgtagtgcatatgacatgtagtgtaatccatccttaccctgaagatttatcttttttaaatgtacacatgactttttagcaatgaagaaaatttcaatacagttggtgtcactcttacccaagtcaactggaaaaagaagtaaccaagtcaggtgttgaatcataagaggggtaggtaaagaataaaagaaaagcctgaacagaagtggacttttagaataaaacttggaataggtatcacatgataaggtaaagtaaatccaggttttagaactatctttctatgcctgggagaagggaaagagctcagacccaaataagagagactgagagtatatgtgttcagtgctaaattggcagtgctaagcctagaacacagtttaggattgcagactgagtaggttaaataaagtttctgcttgttcatccattttaagcatccacagaactcttctaggacaatagtaggaatcagcagaccataattaacaactgcaagtcataaaatcagaaagacaaggaacatttggctcaggggaaaacaaaaacaaacaaacaaaaacgtgttccacagaagagcatcattccccattgataaggtttggctgtgtccccacccaaatctcatcttgaattgtagctcccataatccccacatgttgtgggaggtacctggtgggaggtaaatgaatcatgggcgtgggtttttcccatgctgttctcatgatagtgaataagtttcatgaggtccgatggctttataaagggtagttcccctgcacatgctctcgtgcctgccaccatgaaagatgtgcctttgctcctcatttgccttccaccatgatggtgaggcctccccagccatgtgggactgtaagtctattaaatctctttttctttataaatgtcccagtctcagatatttcttcatagcagtgtgaaaatagactaatacacccatgaaagacactaacttctaaccattgacttaaagctgtagggaaagaaaatttgtaaatagatctagtgagcaagagaaggcaatcatcattgattatagaattttcttaatttctaatttagtatcattaacatgctctgaaggaagaaagcttatttgttgtattttaatgaaaagagtataattatctaagattttctaaatttgtgtgtggccttgatcactctgttttcccatcagatcttaaaaatttgcacccaaaacgtcctctacatggttattaattgcagttggaatgcactcttgtgttggcctttcattcacgtatagcaagtgagtgaatgaatgaatgaatgattagtggaatattatatgaatttcttgtttgcctttctgcctcttcagatactaccttcacttagaatgatgcttaaattagaagtgaaactgggattcttatcttctcagatacagcattgcttttcaattttgttcataattttctccatgagttgttcattttagaaaaaccctaaacaaatatcaaattattaggctgattatttataatgttgactaatatttaaatccatattgataaagtttatttgtgtgtgtacatctggcatatggactttgcctttattctgagttgtgtgttttagtattatgcagagagtgtagcaaatttactgtaagattagcccattctgtgagaaacatctgtgtacatggaagtttagcattcttatccaatgtttgtcttcagattttacaaaagctttggaaactttgacaacttttctgttccttgtcatataaaacttattccttatcctcttcatcttagaactacagttcaaattggaaacgataattcaaatatcacattgtgcttataattttagattatatacatgatctgtgaagcagtgctgcacacttccccccagtctgatatccttcggagaagcaaagaaattccatacagtaaaatttaccaagtcaaattaattttacacgaacacaccaactctttttctcaacacaaatagtttgaagacttggagtgctacttcagcatatttctcttcctctcttagttacttacgctcagatgtaagaactcatgtaaagatttgcgtcaactctctacctacaaaccgtaggatgtgttatgtgtttgagaataaattgggcttaaaaggtcttctacccttgcaacttcccttctcctccatttaggccctagagtccatcttgggggaaatggcaccagcaaagcaagttttaaccccagttaccaagctggatgcatgaaaaactacagccttcctttcatatttcatgaatagaaaagaaaactgaaaggaggtaagccttctgtgcaagaattttgaagcctctgtttgaacgcaaaatgagattccaagagaaagaaagaaccaagtccaggtccagggccatctcgcgcattgccatctacctagagaacaccactgagaaaacgcccgccttctctcttgcatagacatgaatgaaggaagcagaaagatgtagagggagtattttcccaatgctcataactccttaaccatggagaagagtttttcttctcttgacaggaaataagaagaggaataataagacataattctgccgccactatcaaagaaacatgtgaataaggactccaactaatggatatagcttaagacatgagtttccaaatatggatgaaatcgatccttaaaatgataaaaaccaacccaacttaagattaatatgttttctaaattaaacacggtatatttctgtttgtgtatttctgccaacctgatcctcaaaatttgaaaatattaacactatccacagttattgaaggtgtggaggaaaatgttctcaaaaaatgttgagagagtatatcttggtacagccttatttgaagggcaattgcctagaatgtctcagaattttaattgcgtatgcctttgagccagtgatgctacctgtagaggaatatcccgtggaaatatttgtagtgtgcaaagacagatgcacaaagatcaaagagaatctaagtgaccacatgtaggaaatgatcatatgagttttagtgtactcagacatgggcaatctgttaaaaccaatggttcctgtggtgtactacctagtagtaggaaaaaacacaagagaaagttgcagatgagtacataccttatagaaagtatgaaccaaatctatttttgtactagaaagaaaaaaagatacacttttgcatctgtgtacctacatacaaaggaatacacaccaaagaagaacagttaatactcctaacatgtgaatatgatggactgattggaaggtgctttttttgttgttttttaagcacatatacactttgattttcaatatgcatcaccatttggcattaagacatacacagaattttttaaatgtgctgccagatgtgaagtttctaaaaacactcagaatccatgtagtagaaaatagttgggtatttgcctgccgcccattgaaaacccaaatctcaatgggtggcttgacagccatatatagacatacatatacctgactcctgtcttgcttagaagaagtaaacccatctaaaaccaatctgccccatgttgtcaggctcaaaagcttattcattctaaaataaccctgaaaagaaaatacttcagctcaaatcacagtttggaaatgctttgcatgtagaaaacaattgtaaaactaagtgactttttctctataaaatttcaggaatataatatttctatgaatgttactgcagattatctggtgtcatgaatgatataataataaggctgcttatctgacaaatctgccaaatgcaaacagagcttttaataagagtattcatcaagtgtggggagataggtcaattctaaaaatgtcaccataatcaaaaaacattaggaagtacaaaaactaagtataatataaaaatttaatgcctatgtagagtaattcaagtctttgcattaactcctctttgtatcattatgtattcatttattttcaacattttgttatacaccataaataaaagtttgtttctttcacttctccatgcctgttttcccataaatcaccttctactgatagtcgtagattattcaggaagaacaagataatggagtcttgttttcgagtgtttttctttattctaaacattccatctgtctaactatatttatggtatgtaaaacacctgcttttatttccaagggacaaatatagttctaaagtcacagctggtgatagtctgagagggtgttcagatactatttctcaagcaggacagatggctatcaaaagaaactttgtaattttattttttatccccatcaagaaatttggacaaactcacagaactagaactgggaatacttcaacatgaacagtacaggactacatgtgaggaataatcataggcatgtgacaatggaagagatcaaacactaggattcctaatctcataagaataatggcaatagcgtcaatacttaggactaaatggtggatgagcaatgatttccaagagccatatgaactaaacagttagatgtaactagctttggccaggtctccttcagaacaagcaatggcagagaacactccctccagtctgaaaatgaaggtaggcatgaaacaggtaagtttagattgatttgtactaggatgagatgtccagaccaatagatgttttgggatcaaaggtagggctaccaaaaaaaaaagatattgacaaactgttggagacagtgatatggacaattccttatgtaaagggcaaagttaactctaaaagtaagacttcacctgttgtgtaatcaacttgggtaaaatcaccctggaaggtgaaaaaaattctgatgacccacaccataaatttgttggtaaaccagatctttcaaccttgggcaatctaaaatgcttcttctttgtctccaggctgcgtgagtttactgaaacactccacacatgtacaattagtaaaactgataaaaatgtacaagaaagagagctctaaaaatgaatgagagagaataagaatatagataatgaagagacatcatgaagttacaggtattagcacttttgacctccttagcctgagtgaaccaatctaattataacaattgtaacattacctgtgcttgttttgtctgctttgtatggcgcttaaagcatgaagaaaatcagatctatcagactgtgattttaatgaaatgattaaaattatttgattaggtgtgtactcaatgtttaaatgtctatgggaatctaatttgttaaattgattcgcttttgctttattggctacataaataaatatggatatttaaaagaatgctacataaataaaaataaaccagatcaaaaagtaaaaatggtggtgatcttaatgtgcataaacttttgggatattaagtaatttctcaacactaaaaagggcagatgcctcagtatttcacattgtttatagcttgtacaaattaaactctggaaatactggtaaaggaaggatgaaactaaagatgcaatgacctctggaatacggtaaatacattatataaatctgaaggatataatcactagttgaaaatattgtggttttaacatatttaaatcgagtgataggaagcaaagaagatcactccatggaagtatttatagctattagtagaattcattcttaagagagattttgacactgcaaggaaaacttgcaatataattcagcaattaaaggaataagttgaaagaattaaaaatcaaatgacaaaatgtaaaattggcaaatatattatatatactttatcatacatctagatggggtatggggccacttgagaaaaaaaacaacattttgagggtttaagagatggtgaggatgagatcagtgtttggttacagatatgtcaagtttgaagatgtttctgagacacccaacttgaggtattttgtgagcagttagataaaccagtctggggccatatgatggtaagtctggaccagagctagaagttgggagtcatcgactgatggattgcacttgatgcctgcattactcagcttagaagagtgagtgggaaaagcagagggttcacaagatcatctgaagagctctgaccttgagaggttgtgcagaagcaaagaaggtgacattagacacctaaaagagtgcccaaggacttaggaggaaaatggcaggagggtgcaagtgtttggagacagcatgctaaatactgccaggacatgaagtaaggtcaagaatgaaaaatgtcccctgcatttgtcaactcaaatacctctttggtatcacagcaagagcaatcttgatggcatgttgggggcataccctacaccacgatggaagaaatgttcctaggaaatgagtaaacggaggtggcagtggtacgactactgagaagtttggttctgaaggtgagtagagagatacggtggtgccttaagaggaaagtggggccctgggaggcttttatttttcacatgggggatattgaagcctgttagtggcggagagtatgaaggagaaagggagaggttgatgatgccggagagggtctatacatggtggaaagagctcccagaaaaggtaagatgtgttgggctacaaagtcaacacacatttcgggctttgagagagggagagacattttctccattttgtaaaagggaaaaaggggaagttggatatattgaccgtgagaaggtgatggactccccattagatgtgtttcatttcctccatggtgtggaagatgaggtaatatgctgactctgaaaagaatggaggcaccatgatagataaggagaagagaggaagaacaaaaccgttatcccagtggggaaagtgaaagatgaatttactaggaagcactggttactggctctttttaagtgttaaaattaatttaatagaatttgaaaactaagatttttgcaaaatgtggatataataaaaatataacctataaattattttataaagccttaaccctcaaattattaacaaacccctaaagtgattctatcatctgaggtagaaagacaaatactatcattacttatcttttaaaaaggttactaccaaatgctctattagttattaatagtatttttcctggaatggtagtggaatttgtatattcattttctattaatggcaatagtaaagcaatgttctctaatgagttcagaaacttgctcaccaacactaccgttctatgtacagaatgtttcataaaatttcatatcagaaataaaacttttgattgggatattttctggtttctcttccaaactcccatccctcatttcttccattttcatcaacctacctaaccaaacctaacccaggcagccatgacaccagcaggcattgttgccatcctaggcttcttcactccacaaccttccaggctcccacctgtccggctcccactaccatcgtcctagttctctgcttgcggttgcagactatttaagtgtggtaggatgctataaaaacatggtactgttttcactaattgtcaaaatacataatctcagctagtctcttgcattttctctggtagacccccactttttcatagctgttccaaacttagatgatttgccttttattctgaaagacaacagacctgctcatgtttctcttctctgttcccaaatccctttgtcatagccagcttctctctcttcctaagattatgcttctctcgaagagttctgtctcagtcctccatcagtgtttttgatctgccctatgccaactttcaccagaaactcgctcaacaaatggactgcctgggtattctcttcctgtcttccattctctggcccttctttatttgctgacaaatatgccccattcttctttttttcccatcatcctactgtccacaacccaaactaatttctattcacacacctaactttcaattttacagccctctctccatgtttttaatatcacacaacttgggaaaagttagtttataaaatacagcaatgttgtctgtataatctgtcactaattacacacttaaaaataaatttgtattcccatcaccatagaaaccaccatcttagctttgcttctcaaaacttaatgcgcatacaaatcacatgggattgtagttaaaaatgtggtttttgtttagtagctgggagatggagcctgagagtcttcatgtctgataagctcccaagggatgccccaggattggttcacagaccagaatttgaaatgcaaagagccagtggatcatcacccaaagtcttgttatttttttttttacaggctgtcatttgaagattaaacctaaaatagtgtctatctatttttatcttttccctctttaagtcattgctacttgtcttccaagtgcgtctctccatacaatccattctcttcagtcatctctgcggtgtcacatccaatagatttttcttcatcatctcattggctgcctctgctgaattcaacacagactactcatacaatgaaacggtacaactgtggcttctatggaggaagagattccccttatagcattactgggtaacatttatgttgtgctttcgaaaaaaccaagtcataaaaaggtttaaatatttacctctttccatgttgcttgagccacaggccaacaaactgaacacatgatttaaaaccgaactgtcaggatatccagcccctatgcccacagcaggtcagggatgatacatgacttaatcatgcccaatcagaattctctcttacactttctttcgggcctattaaaaaaaaacaaaaacaaaagaaagcttatactctgtggctgttaaaatatgatagaatgtgagttttgctctgagaacagccatctcacccaccatctgtagatctgttgtgaaaacagatggcatttgaatgccttcatttcagctgctatgcccaggtggccaggagatagccctagactgtacagctatatgtacttgtaaattcctttctctttctttgatctctctgtggcttgtggtaatttgtgttgggcttccttcacatgcaacaaaaagttttgacaataatccctcataaataatctcttatctatagatttttatgagaaaaaaatagctgagaaaatgacacgtctacaatagatagaaaaatttggatataaacaatcttagtaactgtttttaagttttataaattaccaatttaacaattgggaaaataataagttagctatgtttttatggggttttcttctgtttgtttgagacaggatctcattctatcataaaggctggagtgcaggggtgcaatcatagctcactgcagcctagaactccttggctcaagcagtccacccaccttagactcctgagtagctaggactacaggtgcacgtcaccacactcagctaatttaaaaaaaaacatattttttgtaaaaataggatttcactatgttgctcaggctggtctgaaactcctggccccaagcaatcctcctgctttggctgagtcactaggattataagcctgagtcaccaggcctggccagctatgttttcaatgtctaaaatgttacttagtaccctacatatatattaagaattaacacattggaaaaattcagcattgtattgctcttcctggaatattttcaaatggctaaaataaacgaaagtaaaaatgaaaataaaaagaaaaagatatttctctttactctgttttcctaaaataaaaatatctccagccaggagcagtggctcatgcctgtaatcccagcactttgggaagctgaagcaggtggatcacttgagcccaggaattcaagatcagcctgggcaacatgtggaaaccccatctctacaaaaaaaataaataagcggagcttgcagtgagccgagattgcgccactgcagtccgcagtccggcctgggcgacagagcgagactccgtctcaaaaaaaaaaaaaaaaaaaaaaaaaaaaaaataaataaataaataaataaataaaaataaaaattagcagggtgtggtggcgcacacctttggtcccagctacttctgaggctgaggtgggaggatcacttgagcctgggaggtagaggctgcagtgagctgtaattgagccactgaactccaggctgggtgacagagtgaaaccctgactcaaaagaaaaaagaaaaaacaaaaaacaaaaaacctctaatacctctttagaaaaataggcaaaagacagtgagagaaaattcactgaagaatttaagaaagtgaatattaagaaattacatatacagcatggaatactatatagccattaaaaagaaggaaattatgttcattgcagcaatatggatgcagctggaggccattatcctaagtgaattaacacaggaatagaaaaccaaatactgcattttctcacttacaagtgggagctaaatactgggtactcattgacataaagatggggacagtagacactggggattactagaagggggagggaggagaggggaaagggttgaaaaactgttgggtactatgctcagcacctaggttctgggatcacttgtaccacaaacctcagtatcacacaatatacccaggtaaaaacctgtacatgtacccccagaatctaaaataaaagttcaaaaaaaatttttaaatagatttaaaaaatagttaatcttttttggctattactgagcatttattctgccaattgaatttttttttttttttttttttttttttttttttttttttttttttgagatagggtctcactctgtttcccaggctggagtgcagtggtgtgatcagggcttgctgcagcctctgcctcccaggctcaggtgatcctcccacctcagcctcccaggtaactgggactacaggcccataccaccacacccagctaattttttgtatttttagaaaagctggggttctgccatgttgccaggttggtcttgaactcctggctcaggcaatcctcccaccttggcctcccaaagttctgggattacaggcatgagccagcgcgcctggtctggcagatgaactttaacatctacttgtcacattttgaaaaccaaggttctgagtgcgattgccatttgtaaaatttgtggtttaatatatgggtactcaacaccaatatacaacgtaattttcccattcagcaacataatatgtctagtatcacataagcagatttaatgtgcagagtttttgaatgtatcttgcacattttctgtgtgttgccatttttttttgctattgtgatttcatttttctacttttaaaatttctggtgatataaagtattattaatttcaatatattcttatagacatttgagtgaattctttaacttctcatattactttttcagttgattatactgaaatatttaggcattcagttacttatttattccacaattattgaggatgtgcatgatactagagacaatttacaaatataattgttaggttttgaagggaaggtgagggttaaaaaaagacacacacacagaaagagggtggctcaacagcaaatgcaggctttgtgtccagcataaaacctaaagaagtgggggaccagcttaatgccagagcccaccgctgcttacaggctgggggtacttgggtttgggcagtatggcttgctgcctggcgggatgttgataagatgttcccacgataaggtggttctggtccttgttctggcgggatgtcatcatggtgttccttggatctttgcccagcaagatatgatagggacgtttctttagttggggctttgtctgccttgtgatcaggtggttaggcaggatgtttctcacggcccgaacccccgtgaaatgtttcactttgaccaaggtcagcacaatagcggggagcttacataaaggtgcagtttggactcacattctttcaaggtttgcaaaatagcggggagcttacaaaatgatgcagtttggaccaacagtaatgattccagtatcttttttttcattttattggtttttctttttctttgttgctgcattttccaagtcttgcagaacagtgtgtggaatagcagagatgtcaggcacacaagccttatccctgatttaatgggaatgctcccatgcttcatgacccagaatgaggcttgccatttgattgtgagtttttaaatggtattttactgaaacttcttttttattcttgagtatagctattttattaatctatcatgcccagtgaaagaagagcattttcaaaaggatggtctgctttgactgaataaagtcagaaaagggcagtgttgtgtctacaaaagaactgtatggggatgatgccaatctctctgatacagcacctggagcattacacacaaccctcacaacaacatcaaaaaagacttttaaaatttattattatttttattattatctatgattttacattatttgtgccaaaagcatattaaactaatccaaaaggaaaagctaaagatcagtcccaatagcactagcaccatcagacaaaacaaaactactgtgagctaatatctctaacaacgtcttcaaaacagcagctgggccatcatggcacaatcctgtaatcccagtacttcgggaggccaaggtgggacgaccccttgaatccctccaggagttcaaggccaacctgggaaacagcaacaccccatctctacgttaattagctggctgtagtggcatgcacctataatcccagctactcagaaggctgaggcaggagaatcgcttgagctcaggagttcaaggttacagtgagttatgcattcactgcatagtgtcactgcactccagcctcagtgatagagcaagaccctatttctaaaacttaaaaaaaaataagaaaaaaggcagctgattatgattgagcaggcatcattcgtatcaaagtcattgaagatgtgcattacaatagcaaaaatacaataacttcccagcaaacggcaataaacctcttgaggaaataaagtcattttttgaattaatgcaaggatactattgggagtgaggatggcactgatcctgctatgctttttgtggggccatcttcccccttagtctatagcaccatagactattttattctatttatttttgtaatttaataaaatccccatttttaaccttgtttattgactcatttacttgttactgctttctcacccagtaaaacaaatattcccttaagtcaggaacctgctttatttgttttcatctacatatcaagtatgtagcacaaattctggcacatagtaaattctcaataaatatttatggaatagaccagaaagcaatgattaaataccttctttctgacccttctaatccatagaagtactttgcaaatcactgatattttgaaatgtacattaaaactacattggtaccctctcaatcttcccagttatagacaataatttaattacaccatttaagatgacatgcaggctaaccagtaaattgtagccactaagtaaatgtgatagatcaatatagaacatgaattgtagaaagatctttaagcaaagtattttacaatgttgattgcatattctaactccatatgcattctttttttaacagtaagttaattatttcactgacagagatagtgaaggtattgtaaaacacaattaaaaatatattatatactgttgttatataaaataacaacaaatgaaaatgaaatcaattgcactttttcatgctagtggcctggtgtactaaattgttcaaggacaatctagccaactgattttatgtttattgttgcaaggtgacaatgacctatgttagatataaagtatttgcatacttacaggtatatttactttatcttaatgtccacaatgtggctaaaaaataagaatactttttggtttatataattaattgattaaagaatttcatcatggaatgactatcaccatttaagtagctttatatagatgaaatacataaactaaggaatttttatccatagcacccatagaaaataatcatgcttttgagcagaaataatttctgagatattctgtagccataaagttaaataaaacatatctaagacttaagaggagaaagaataggaaattattttaaataaagtagtaattatttttggatgccatattttttgtaaagtcttttaaacacaagttgagaatttcagtgtctgtgttgttctaagtttgcattagaatgttttcaaactgcagattgtgatccattagtgattgtgaaattatttaagtgtagcatgacaatttttacaaatcaaaatggaataaaaacctcaaaaaatattacacataataaaagtgtttcataaaaattatttttatttatatgagtaaatagttttactcaaatttatatttgcatatgtacacctatatgcatatggaaatatatgtgtaaaatatgtgcatatatgtattggattaccttataaaacaggtcatattcaagaaagattggaagtcattgaagaaaatgttgtaccaaacattagaatacataggtggctataatatgcaaccaaaatgtattcagttcttagtgtgtgaggaggattttgcaaagactgtcagctaaaaacaacttcatggtgaaatgtaaggaatgataatgtgataagccatttgatctccttcagctcctcctctcagtttctgagtgttaaggatgttgtatttgaaggcggacactcctactcttttaccccacacgtaagttctagttaagcaccaggttcctagttgggagacagatgacaacctctcctgttttaaagacacatgtcaaagctgcatatttgtaaatgacaacctaatcaaagcccctttatgtttcctaactttcaatgcttactttaggaggaaagacctaggtaccctaaaacaagcacaactgtgctgccctacacaggaattttttaacataagaaattaataaagaaataattgttaagttctcatctgctttttcaccagttgttgggcaggtatttatatacagttcatctttgaacaatatgggggttaggggtgctgacttccctgtccaccactcctgtggtcaaaaattcacatgtaatttttgactctcccaaaatgtaactactaagagcttactactgactggaagctttaccaataacataaacagtcaattaagacataccttgtatgttatatgaattatacactgtattctcacaatcaagtaagctaaagaaaatattaagaaaatcataaggaagataaaatatactcactgtttacttagcgaaagtggatcataagggtttttgtcctcgtcttcacattgactgggctgaggaggtggaggaagaggaggggttggtcttgctgtctcaggggtggcagaggcagaagacgtagaggaagtggaaggggaggcaggcacacttggtgtaatttttactgaaaaaatccacatggaccctcatagttcaaacccattttctccaagggtcaagtgtacattgactctaagtggggtcctttagcagcaagtaatagaccctggctgtgttaagtcacacagagcaggtactggaaggatatgatatgaacagttcctactattggcagctggtaggagaacaggcttctaaaactcagctacttggcatcaggttggccatcctaggtcactgtggctgccactgtttctgaggtgacattgactttcctcaatcattctctattccaggtggcttccttttcaggcacaggtcaggtgatcagagtccattttccagtgacatgactcaaaccttaggtcctcagggatgtgtacccttgcttctgccatataaggttgcaatggcttcccactaactattccactagtgctggttgtagactggataaccggaggggttaccccaatttcatgctcattcctccctatccccatcatatggcagcaaatccatctccccttgacaagtacaataagatcatccattaccatgattctgttcagccagtaggaggaggaaccagaaatggcaaaatagaacagatcatttccctcactgggagtgattggcgctagtaacccccttggatttgaaattgtcaagagatagttctgactgaggttgatcagtagagctaaattgcctagttccatgaccttgccaggaaccaagttttggggttgatgtgtccacagtgtcaataagcccagtgatcaccccttcgaccattttaccttcttcctggagtaacttcaggatttgaacatgtgtcatcctgagcctttcctccagggggtcctcttgtgagtggtgggtgtccaggtgagtggtgggtgaggggtaatagtgaagtccctgtcttggctagcaacagacaccagcacatctcgctgttggacaaaaggagaagcagccaccgtaaatcttcctcaagcttcctggccctttcacattgcttgtgtggcctgaattatctcacatgattgttttcttagttgctcaggtgagctccgtgaagggagggatccacaaaagtgcccagtagacttttgcacggcccaagtccaatcttgcaagggacagtttatgaatcagggacccacctgcagggccatgagcttggccatagctggaaggtcatgttgcaaagccattgagcccatcaagggagggctgatattcttggactggctggaactgtggggctttccaagagtagagtacgcatatgcactttactaggtctgtccacaaaagtgaatctgactatataaaggttaaagagcacttataaactcagtgaaatcgggcattacataaatgctgcttcatctcggcacagttaaaatgcagctgctgtgacatgttttaggtatgtgtatatgtacatacatatatatgtgcaagtatgtttgttcatattcatgtttttcacaaattatcttatttcaagattaagttggatgtgatattatgacttgtacatgactgtgtactcagacatgcattctaaagtatgaataaagttaaatcatatttctcccctctaagtcagtcaaaatggggaaattatactgagttaggggatatgtgtgaggaaaaataaacatgtgtgttagcattaagtaagcagagctttgagttgtgcagttagaaaaaaattgaagtgcagaactaagcaaataaatggtgaattctgcccaaagaaactgtcaatttgcaaatcagaatcatgatagctgtctaaaaatctgtccactttacatgaactgcaataactgccttccttcctactttatttagataattacttcaacttctgattttattttgctatcacgtagacaaaatttaggcaagaaaaatcccaaaacactgatcttccatagttaggctcctcaattgtaaaagtaatagactggatccaaaaactttctacgactaatatttataaacatgtttttatgtaattgtatttatcttttttaatcttccaaaaaattaaaagcataatcactaatatctgtgtattttgagtgctcatgcttgtttagaatcaaaattcaatgcccagagtggtgagactgtatctttgcaagcttctagtatacacaccctgcacctgatattaagaacccagaattaacagtttttttttctttcttactttttaatatatggcttgttcctttagagcactattgaacttcaaaaccaaacctattttctctaattgtcaatggaagcactgggttaccatagttacatagtaaagtgtcttattgaaaagaagaaaaggaagactaatgacatttttaatgacagattcaaatatataaggaaattgcccccacagggaattgggaatttatcaagctgccaatcacagtaattaccctgcaaacatatcagtatctgggtcagaaactcctttcagattttctatatgccagttctacaatgcctcaaaattttgatcccacaagtgaggcagatcctgttgtgaatgcctgttttcaattagtatggctgcatgagcacacactccagcaaaggtaagcagagcatgcttggtagcatgctcacaggagaatttggtgcaccagccccggagagcgcctagtgtgcaccaagtatgtgtttcattacaccgctgtattcccctcatgtaggaaagttgctgcagactgatacgtcaatgatcttacagtatttttaaagaaaagtaccaacacctgggtgataaattaatctttacaacaaacccccgtgacacaagtttacctataacaaacctgtacacgtacccctgaacttaaaataaaagttaaaaagaaaagtaccatcctcccacagggtcaaatacatatgtagtcgatacaagatacttcaaaaaagtcttatacaatgagatttggttttgcagcttaaatttcttcaatttaagggtacatcaacaaggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagaggccatcgttggtgtttatgtgctaaaagttgtgtattttggcttctgagaaccataaaattgactcaaagaatagtttcaaagagtaaaagaagaaatgcgtgacaattgaagacatggaattaaattggtttgtctctaactgcctcttagtaatcaagagttcttgcttggcaaaacctcataaaaacagatttaggatttaagacagtgtcagtaaattggtacaagcccatacacaagtcctcaaagtgatggacaactactcagaaagtaaaaaacctgggatcagtacaacgtgatttaaaaatgagaagtgaatgattattctggatttaattcttatttactaggctacttggttctttgtgtttagtagtattttatctatttaagttcccataatagatgtatccagtatatagaacaatagctaaatactcagagaggtatggcgagagagagagagagagagagagagagagagagagagagagagagagagagagaatgaatgacaaccagcttgataatctcctaaactggggtggggtttaggggaggaagatgagaggggataagcctcttcaaaatctcctaggcttctggatatctgcccctaactgcactgggagcaactgcacacacctgtggaaagcaaactgttatggtttggctgtgtccccacccaaatctcatcttgaagtgtatgtagctcccacaattgccacacgttgtgggagggacccagtgggaggtaactgaatcatggaggcaggtctttcccatgctattctcatgatagtgaacgagtctcaagagatccgatggttttataaaggggagtttccctgcacaagttttcttctcttgtctgctgccatgtgagacatgcctttcaccttccaccacaattgtgaggcctcctcagtcatgtggaactgtgagcccattaaacctttcttttgtaaattgcccagtcttgggtatgtctttctcagcagtgtgaaaatggactaatacacaaacctttgttcctccagtcctgatcaaaggtctttaaccatgagttgcctatttctcaaatccttcctctcctacctagttccttcagttccagagctacagggacacagctaagtcacggaaacacccatgcttcacgtcaagatcatgccacatattctccatggaacctaagtggtggccctccattttccatgttcctcaatttacccaaagaacctatcctcctccattttttaaaggacacaacagttcaccaaaaatgattccttatcacctaagtgtatccttcttaatgacgttgtcaaattctaataaagtgcctcttatatccatgtgctaagtaataattcaaatattaaaaataaacacaaatattacaaggagtaatacaattgagtcatgatagattttctaaaaaggatttgattagaaacttccatcaaaaactatctaaaacgtgttttgcattataaacttttatgcattttattcaaaccaattttctttaagtaaaaacttaacagtgtcatcaaaaccacactgatacaaagattccattttcctcttgcttgggggaaaaagggcttggttgagtctcaccaggtttgccagggacaactagaataaaaagaccaaaatttaagctgtaggatattgcagtacaggtaaatatacactatttttataatctaggttttcttatcacagatacaattagcagtaacaaaaaatcagtaggaaaaatttaaacttcagaagttacctccactgatacactaaaggagagtttctcagccttggtactgctgacatttggggccacgacgtcttaactgtgggacagtcatgtgcactgcaggacgtttaacaccattcctggcctctacccaccagatgccagtagcaccactgggacatgataaccaaaaatgtctagtacaatatcatcccatgtggaaaactattagactagattaagggaatcagtatttttatgtcaattattcatttgggtccctaagtttttctccactatttttatatatttcattacctccatctttctaagcaaataaatgattttatttaaaattgctctgggccaggcgtggtggctgaggcctgtaatcccagcactttgagaggccgaggcaggtggatcacttgagcccaggagctcaggaccagcctaggcaacacagtgagactttgtctctgcaaataatttttttaaaaaagtagttgggtgtggtggcacgcgcctgcagtcccaggtacttgggaggctgaggtggcaggattacctgagcctgggcggtcaaggctgcagtgagacatgatcttgccgctgcactccagcctaggggacagagcaacaccctctctcaaagaagaaaaaaattgctctgatatcctaccaagtttattgatgtaaaaaagaagtgaagaaaaagcagtgacagttaataagcagcaaaaatgggtgggcgtggtgcatgtctgtaatcctagtgctttgggaggccaaggtggaagaatcacttgagccagggagtttgagaccagcctgggcaacctagtgaaaccctgtctctacaaaagataaaaaaattagccccgttcctatggctgatacatgttataaagtattaaacaacacactaaggagaagatgcaactcctacctacaattatcaatgaacttccagtgcttgggaaacacgttgaattctgtgggaatttttagtagatcagaactcttcaaatatcactgaacataattactcaccatgatatcctgcttggcgatattaacatacagatctagctgccctttgtcctgcggggagatgtccagtcgtccactgaagggggagatggttactgtccggccgacgggcaggatgggaagagcgttggtgaggcctccgtccacccacttctgtggaaagaaacatctcacgtcagcacacgtcaacaacacatcctgcacaaagaaaagcagcttctaataatatgtgtgccttggatatgcttttaaattgctatttttgaggactaatcccattggggatctgttctgggggtaaaacaaatcttggtacacatatcacttaccaatataagaacaactctggacagaatttaactagattattgtctgtaagacttgaattcttactgactacagtgcatgcttaagaagccatgtgtaattagattggggttcattatttaatcaaactaaaaagtcaaatttactgtggatgctgaacaaaacatccaccagcagaggaggttccatttttattatatgaattggaaactggcattttctgtggcaaacttaaaaagtaaatacagcaactagaaatgcttctaattccaaagtggttcctgtgctcttgaagcaaggggcatgtcctgaagccataaggaatgggagtgctgcatcaaagcacacattcctcagtaggcactcagtgctctcaagcccaccgcaaaggggagtgagtgatggagaaggcggaggacagaagcctcccaaggaagaaaatgaaagagtcttggggcaatgaggacggacaatgaggtgctcaaggtgtgtgcagcctcagcccctagctctacagaagcgcacaatgagaaatggtgactgaagaaccacacagacaatattccttctgctgtctattccaaggccaaacagtctcaatgcagccatgatctgatgtattcacatgatcagctata

SEQ ID NO: 165 - DNA, 10032 bp, Homo sapiens
  source 1..10032: mol_type = genomic DNA
aagtatttgacaccagatggtgaaaaaaaaaaaaccagtgttttcaaatagaaactcttatttcctgtgtgattaatgagttagaattagtactggagctatctctatgagatgtggatttcattttggggggtggtacatactcaacagatgaaattttgggtcatatggtagttctattttgattttccaaggaaccattatactgtttttcataatgtaccaataacatttctgccctgtaagggtccccttttctgcacaacctaaaagggtttcactctctccacacctttgccatcattactttttatctcttgactttttgctaatacccgtcctaacaggtgtgaggtgatagttcattgtggttcatttgcattctctgattattaatgatgttgagcacattttcataaacctgtcagccagttgtgggttttctttcgagaaatgtctattaaagtcctttacctattcgtaaaccagactatttttttttttttttttgctattgagctgtatgagttctttatatactttggatattaactcgttattagatatatggttcacaaatagtttctcccaaaccataccctgccttttcattttgttgattgttgactgtgcagaagcttttagtttccaggctgctcacttgccctacatatttcagcttcctagacccccacaatgtgtgaatgtgtgagccaattgcttagagtaaagcatatcgtatataatattattcataaataaataccatacaatagtaaatagatgtttatgacatatattacacacacacacacacacacacacacacacacactcacacaaatatcctgttggcttagtttctccttctctgaggaacccagcctgatacaaatacccagctgagcgagtgtctttgctgatcttcaccgcctgaagccagtgctttaaaccatgagaatgaaacattgaggggcactatgtggacactgggagaaggaagtgagatggaaaagttctttgattgcatccaagaagtgaatggtcctcaaggtgcagcagaggaatttgtaggagagagggatgattgattgacggctttttttttttttttttttttttgaggcagagttttgctcttgttgcccaggcttgagtgcaatggcgctatattggctcactgcaacctctgcctcccgggttccagcgattctcctgcctcagcctcctgagtagctgggattatgggcatgcgccaccatgcctgactaattttgtatttttcgtagagatgggttttctccatgtaggtcaggctggtctcaaactgccgacctcaggtgatccagccaccttggtctcccaaagtgctgggattacaagcgtgagccactgtgcctggtcaactgacgtcttcatatagccctccgtctatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacacggggagtttaggaggggtgacatgtcagtttgggaactatctttaggggtgctaacccaaatctccctttctccaattagagcaccctgccttcctcattagatgtcacccccccccccgcccccgacttcatccgccatgtcctgatggtgctttgtgacgtataaggccttccttcccgcccagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaaggtgagtgaccctcccaagctcctcctcgtcttcccctcgcctccttcctcacaagaagcctctcctgtcctcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgatctgagtgactctgtgttctctgatggtggggagggagggagggagggaggaagaggtggtgtgtggggagggagggagggaggaagaggtggtgtgtggggagggagggaggaagaggaggtgtgtggggagggagggagggaggaagaggtggtgtgtggggagggagggaggaagaggtggtgtgtggggagggagggagggaggaagaggtggtgtgtggggagggagggagggaggaagaggtgtgtggggagggagggagggaggaagaggtggtgtgtggggagggagggagggaggaagaggtgtgtggggagggagggagggagggagaggaggtgtgtggggagggagggaggaagaggtgtgtgaggagggaggaggaagaggtggtgtgtggggagggagaaaggaaagaaggaaggaacaagtggtatgtggggagggagggaagtggggtcccgtggggttgaggtcagggggacaggtcacagttagccagacaggaggataaggattgcgtcatggctgagcactggagacaaatttccccttcacaggatgactccgcttcttacacggtttgtttcttcatgcaatcttgctagcacatacaccaagtaccaagaactggattctacctacttaggtttcactgtcaaaataccttttcggttatagaaacctatggaagaatcgtttccatctctttcctttcagcgtcccctccctacaatctaatataattaagaagaaaaattcaaagtagagaaaaatctatctacttgaaaaaagcctttttatttttgcaactcaggagacagaaagtacaattcatatttccatacattagaaatacacaggtcttttctacatctagtagaatttactatatacaaatatatgtaaatttttatataaataaaatatacaactatatttactatagacaaacagattatatgtttacatataaaatatatacatatagacaaaatatggaatatatatttatatataaaatatataagtataaataaatgtaaatatagattatacacattagaaatacacaactcttttttgtacatagtagaacctattatgtatatttatatattaatatatcttatgtttttatatttagattacatatataaatatttatattctatatattatatataaaacattaaacatatatttatatttataaataatatatcaatatagacatcaaatctatatatgaaacctatctataaatataaatacatgaaaatagatatatataaatatatataaaatatatattctatatgtgatcatttattttagaaggtaaggtgttgtgattgttgaagcatccttcacagattaaaaaaagaaaggaaattatcattttaagaaaaataaaataaaaataaaaaataaataaagtacaaaattcccagttgtcaataattacaatgagagaataatatagaacttgctatatatagaaagtatttctatatatatttctaatatatatattatgtatatagtatttctaatgtgtatatatgtaatgtacatttatatatataattatataaatgcacagatcttttctatatatagtataatgcactgctgtatttctaatgtgttatatatattaaacctatatttatatatatttatataaatacacaggttttatacatatttatataaatacacaggtatttatataaacatataaacacacaggtcttttctatgtatagtagaattttgtatagtagaatttatgatacatttagaaaagacctgtgtatttctatatttatatttagaaaagacctgtatatttctaatggatatatatatagtttgtatttatatgtatatttatagataaatatataatctctatatatttatatatctatttctatgtatttacatttagatagagatctatttcacatatagattatataaatatattctatgtaaatatataaatacatatataaatatgtaaatatatttatatttatgtataatatataaataatatataaatatgtaatgcataaagataaatatacaatatataaaatatatattctatatgtgatcatttattttagaaggtaagctgttagtattgttgaagcatgcttctcaggcaaaaggagaaaggaaattatcattttaagaagaataaagtacaaaattatcacaatttaatttccagttgttaataattacacagacagaataactcatgtcctttaatcttacaatgaatagcacgttaaacttttatgtgattctgaaaatatgaatttccatataataagggtttgagatgtaaagcactaactttataggcagttttcacttgttacatagattgttcttagagctttaaagatgttaaaattaatggtggctttgaagagatggtagcatcatttgagaaacaataaatgggttctgtttcatcctttccttggtgcagtcagggcttcacttcattagcttaggaagggatttcagagctttgcatgttgatcttgtagttgcctcctgtggaatcctacgaaacctaggacgctataccacagaaacagggccttgccccatgtcctgaacaccatcattttgtggtatatttcttttgtattatttcttatatggaaataccatataagaatgagcatgcttggtataactcaaagcctgtttatttgcaaggctgtattgaccctggacaataaatatttgtatgttacggatgagaaacaagtctgcatgaaaagctcctgctgtcttttaggaaagcgtattggctgtggttgtatatctctttccaaagggaaattggtgaactctctgctatagttttttccataatgacagcataaaaactgaaataaacttatcttgtcagtggccacttttggggttggtgtatattagggagcacttttgcaatgtgtttcaaaattacattcaaggattaatttcatgcaccttattttaatgccatatttccattcaagctctgcatgtcaaaacagtctgtgatgattcttttggcattgaaataattatccatggcacttaaaccgtgtttctttcatcatttcatggcagtaggagcttcaactgctatttgttgggaacccatcctgactagctctttcactagggcttcatgttttattgtgatgattggcagacttgtgtttcagacattttcagatttggaaagttactatgattttgaaattatagatgcaaaaatgtcattgaatttactttcacaaacttttaattcattatagacaataagaggtttaatcagaaatcaggccaggtgcggtgggtcacgcctgtaatcccagcactttgggaggccaacgcaggcagatcacttgaggtcaggagcttgaaaccagcctgcctaacatggtgaaacactgtctttactaaaaatacaagaattagccaggcgtggtggtgtgcacctgtaatcccagttacttgggaggctgaggcaagagaattgcttgagccctggaggtggaggttgcagtgagcagagattgcaagactgcacccactgcactccagcctggctgacagagcaagactccatctcaaaaaaaaaaaaaataaataaataatttaagtaatcttttaatttgttggagcattcacaaatactacatcttcatttaagtctctctttattctacatgttatacacacagttaaattagttaataagagtgttaaatactttccctccttctccaactacccacaatctcaggcttaaaataaacagtggaatgcgtaaagacccaaaataatataacagcaaaggtgcagttgacttttgtaatcaaatgataaatatcaaagcttcctgacgtttttaggcaaatcttcctgtgtccctaaaaggaggatccccttgacagcagtcatgaacaacaggtgatctgaaattctcagctgtcaaagacggtgggagaatttgaaaacaccttgtacatattaaagagctaagcatgagctgatgcatacatacatatgtctctgtctcattagaccacaggaaacaggacacatggcaggaaggctcacgtcgattccccttgaccatgcagcttcctctgctcctgactcctaagaactttctgacctattggtcattcccagcttcagatccccacgcataccgattgtttttggccccacgtcagtgatacacacgacacagaattgctctcaaaaaacactctggaattgaaaaatgacaggggaagctcaacgcgatggctgggtgccagagggaaggccttccgctgttttgaacactgatgctaagctctagaataactgtagctgcagcctgttggacctgggcatgtgtcaggcagggtgtgaaatgctccccaagcacgacctcatttctccctcacgttacccctgtggattaatcggggctctagagagacaccaccaacaggttatcagcaaagatagatgagaggggatttattaggggaattagagggtgaaaagtctcaggacaggctgtctgcaagctggagcccctgggatgccaggagcgtgactcaggtcacaaccaaaaacctcagaactagggaagtggatggtgtaattctcagtataaaaggagcctgaagttctggtgttcaagggcaggaaaagaagaatcccagctccaagagagaaagggaggaaagtgcctttcctttgccctgtttcttctatctgggccctcagagaattggatggggcctgtctctattgaagacatcttccccactctgtccaccagctcacgccaatcttcccaagaatacctgtgcaggctcacctagaaacaatgctttactaattcctgacgtattccttaaggcagtcacgttgacacctgaaattaaccatcacaccctgtaaaatgggtagtgtccccactggacaaatgagacagacagtttgggtacctttcttatactgcttataggttatagagccaggattaaaactcaggtctgcaaagaccaaattctaaactccaccctcttaaggactgctgctcaacactgtggaagcagtactgcattagacactgtacgaggattgaagaggcattcgagacacatcccctgctttagggaccacatcttagcttgcattcatgacaggagtcatgtttctgtgactctactatagaccccggaaccaagtgtgaattggtacgctttaggtgtgcatacgctctgcagaaatcctaagaaagagccagataattataggctcgattcatatagggaagtttttatgaaaacagcttttagccaattcctgaaagaaaatatttttactggcagaaaaatgttctgctagagaataactagttgaagggctttgggggaaggggctctggacacatgtccacggaagtggggaaaaaagacacacagaatagaaacagaattggggacccttcaggaagagaagtaaggaaaagtgctagcccagtaagccgatatgtaattttgaatcttaactagattgagaatttggatacaactcaaaactagaaaagagtaattgcactaaaaaaaaatggcgcagagcagggtaaattaaaataaaaattcattaataatgaattaaattattcattcaacaaacatttattgggcaccttccatggtccaggtagagggctacatgctaatcaaaaaataataatcgctgccaggactgagcaatgcctgtgagtcatccttagactggtgctggaagatagatggggctgtcttattccatcctgagtttacaagagatgaccctgaggaccagccaggctaaataaccttttccagatcacctagtacttgaaccgaagcttgtctgactccaaagcccacacgttctctgatacgccatgcagccagaaaagggcagtgaagtactaaggtttgctaaggtgttgagtatatggaataagatactcaggagtatttttaaacttgtggtaaaacacacacgacacgacatatacactcttaacaaatgttgaggtgcatggtacggtattgttaactatatgcccattgtcctacagtggatccttacaactttctgggatggttaatattgtcaacttggttgggttgaaggatgtaaagtattgttccctggtgtgtctgtgagggtgttgacaaaggagattaacatttgagtcagtgcactgggagaggcagaccaaccctcagtctgggtgggcaccatccagtcagctgccagcgtggctagaataaagcaggcaggaggtgggagaagccgacttgctgagtcttctggcctccatgtttctcctgtgccagaagcttcctcgaacatcagactccaagttcttcagcttttggactcttggacttacaccagtgtttcgccaggggctctctggcctttggccacagacagactgaaggctgcgctgtgggcttccctacttttgaggttttaggacttggactggcttcctggctcctcagcttatagacgggctattatgggacttcaccttgcgatcatgtgagtcaatactccttagtaaactcccttcatatatgcatctatcctattagttctgtccctctagagaacactaatacactttctcgtcttgtatgactgaaactccatgcccattgcacctcaattccccattttcccctcccccagcccctagcaatgaccattctactttctgtgagtttaactattttagatatttcataaaagtagaattgggcagcatttgtccttctgtgactggcttgtttcacttaagcatgatgtcctcaggtccatctgtcctgtaggagtggtttctgacatcctacaaagtgagagggttttgaaacttgtgagacatgcacaaaggtggagagactactatagtgatcaccatgttttcatcatgcagctccaaccactacaaaagtcagctaattccatttcacctgttaccctctccaaacctgacctatcccctgcccaactcagttattttaaagcaagtcctagattactttttaagtaaactgacttgg
